United States Patent
Maggio-Hall et al.

(10) Patent No.: US 9,650,624 B2
(45) Date of Patent: May 16, 2017

(54) DHAD VARIANTS FOR BUTANOL PRODUCTION

(71) Applicant: Butamax™ Advanced Biofuels LLC, Wilimgton, DE (US)

(72) Inventors: Lori Ann Maggio-Hall, Wilmington, DE (US); Brian James Paul, Wilmington, DE (US); Steven Cary Rothman, Wilmington, DE (US); Rick W. Ye, Hockessin, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 367 days.

(21) Appl. No.: 14/142,398

(22) Filed: Dec. 27, 2013

(65) Prior Publication Data

US 2014/0186910 A1 Jul. 3, 2014

Related U.S. Application Data

(60) Provisional application No. 61/747,158, filed on Dec. 28, 2012, provisional application No. 61/747,161, filed on Dec. 28, 2012, provisional application No. 61/747,178, filed on Dec. 28, 2012, provisional application No. 61/885,924, filed on Oct. 2, 2013, provisional application No. 61/885,939, filed on Oct. 2, 2013.

(51) Int. Cl.
| | |
|---|---|
| *C12N 9/88* | (2006.01) |
| *C12N 15/00* | (2006.01) |
| *C12P 21/04* | (2006.01) |
| *C12P 7/16* | (2006.01) |
| *C12P 7/40* | (2006.01) |

(52) U.S. Cl.
CPC ............... *C12N 9/88* (2013.01); *C12N 15/00* (2013.01); *C12P 7/16* (2013.01); *C12P 7/40* (2013.01); *C12Y 402/01009* (2013.01); *C07K 2319/00* (2013.01); *Y02E 50/10* (2013.01)

(58) Field of Classification Search
CPC ...................................................... C12N 9/88
See application file for complete search history.

(56) References Cited

U.S. PATENT DOCUMENTS

| | | | |
|---|---|---|---|
| 4,683,202 A | 7/1987 | Mullis | |
| 5,643,779 A | 7/1997 | Erlich et al. | |
| 6,177,264 B1 | 1/2001 | Eggeling et al. | |
| 6,699,703 B1 | 3/2004 | Doucette-Stamm et al. | |
| 7,541,173 B2 | 6/2009 | Bramucci et al. | |
| 7,659,104 B2 | 2/2010 | Bramucci et al. | |
| 7,851,188 B2 | 12/2010 | Donaldson et al. | |
| 7,910,342 B2 | 3/2011 | Liao et al. | |
| 7,932,063 B2 | 4/2011 | Dunson et al. | |
| 7,993,889 B1 | 8/2011 | Donaldson et al. | |
| 8,017,364 B2 | 9/2011 | Bramucci et al. | |
| 8,017,376 B2 | 9/2011 | Dundon et al. | |
| 8,071,358 B1 | 12/2011 | Dundon et al. | |
| 8,129,162 B2 | 3/2012 | Li et al. | |
| 8,178,328 B2 | 5/2012 | Donaldson et al. | |
| 8,188,250 B2 | 5/2012 | Bramucci et al. | |
| 8,206,970 B2 | 6/2012 | Eliot et al. | |
| 8,222,017 B2 | 7/2012 | Li et al. | |
| 8,232,089 B2 | 7/2012 | Urano et al. | |
| 8,241,878 B2 | 8/2012 | Anthony et al. | |
| 8,273,558 B2 | 9/2012 | Donaldson et al. | |
| 8,273,565 B2 | 9/2012 | Dundon et al. | |
| 8,283,144 B2 | 10/2012 | Donaldson et al. | |
| 8,372,612 B2 | 2/2013 | Larossa et al. | |
| 8,389,252 B2 | 3/2013 | Larossa | |
| 8,455,224 B2 | 6/2013 | Paul | |
| 8,455,225 B2 | 6/2013 | Bramucci et al. | |
| 8,465,964 B2 | 6/2013 | Anthony et al. | |
| 8,518,678 B2 | 8/2013 | Flint et al. | |
| 8,557,562 B2 | 10/2013 | Bramucci et al. | |
| 8,614,085 B2 | 12/2013 | Van Dyk et al. | |
| 8,617,861 B2 | 12/2013 | Grady et al. | |
| 8,637,281 B2 | 1/2014 | Paul et al. | |
| 8,637,289 B2 | 1/2014 | Anthony et al. | |
| 8,652,823 B2 | 2/2014 | Flint et al. | |
| 8,669,094 B2 | 3/2014 | Anthony et al. | |
| 8,691,540 B2 | 4/2014 | Bramucci et al. | |
| 8,735,114 B2 | 5/2014 | Donaldson et al. | |
| 8,765,433 B2 | 7/2014 | Gude et al. | |
| 8,785,166 B2 | 7/2014 | Anthony et al. | |
| 8,795,992 B2 | 8/2014 | Bramucci et al. | |
| 8,828,694 B2 | 9/2014 | Anthony et al. | |

(Continued)

FOREIGN PATENT DOCUMENTS

| | | |
|---|---|---|
| CA | 2716427 | 8/2009 |
| EP | 1887081 | 2/2008 |

(Continued)

OTHER PUBLICATIONS

Branden et al. Introduction to Protein Structure, Garland Publishing Inc., New York, p. 247, 1991.*
International Search Report and Written Opinion for corresponding International Application No. PCT/US2013/078086 mailed Jul. 8, 2014.
International Preliminary Report on Patentability for corresponding International Application No. PCT/US2013/078086 mailed Jun. 30, 3015.

(Continued)

*Primary Examiner* — Yong Pak

(57) ABSTRACT

Dihydroxy-acid dehydratase (DHAD) variants that display increased DHAD activity are disclosed. Such enzymes can result in increased production of compounds from DHAD requiring biosynthetic pathways. Also disclosed are isolated nucleic acids encoding the DHAD variants, recombinant host cells comprising the isolated nucleic acid molecules, and methods of producing butanol.

12 Claims, 17 Drawing Sheets

(56) References Cited

U.S. PATENT DOCUMENTS

| | | | |
|---|---|---|---|
| 8,828,695 B2 | 9/2014 | Grady et al. |
| 8,828,704 B2 | 9/2014 | Donaldson et al. |
| 8,871,488 B2 | 10/2014 | Dauner et al. |
| 8,889,385 B2 | 11/2014 | Donaldson et al. |
| 8,895,307 B2 | 11/2014 | Li et al. |
| 8,906,666 B2 | 12/2014 | Alsaker et al. |
| 8,911,981 B2 | 12/2014 | Li et al. |
| 8,940,511 B2 | 1/2015 | Larossa |
| 8,945,859 B2 | 2/2015 | Donaldson et al. |
| 8,945,899 B2 | 2/2015 | Li et al. |
| 8,951,774 B2 | 2/2015 | Donaldson et al. |
| 8,951,937 B2 | 2/2015 | Flint et al. |
| 8,956,850 B2 | 2/2015 | Anthony et al. |
| 8,962,298 B2 | 2/2015 | Donaldson et al. |
| 8,969,055 B2 | 3/2015 | Grady et al. |
| 8,969,065 B2 | 3/2015 | Anthony et al. |
| 8,980,612 B2 | 3/2015 | Donaldson et al. |
| 9,068,190 B2 | 6/2015 | Donaldson et al. |
| 9,080,179 B2 | 7/2015 | Paul |
| 9,163,266 B2 | 10/2015 | Anthony |
| 9,169,467 B2 | 10/2015 | Govindarajan et al. |
| 9,169,499 B2 | 10/2015 | Paul et al. |
| 9,181,566 B2 | 11/2015 | Dauner et al. |
| 9,206,447 B2 | 12/2015 | Anthony et al. |
| 9,238,801 B2 | 1/2016 | Li et al. |
| 9,238,828 B2 | 1/2016 | McElvain et al. |
| 9,260,708 B2 | 2/2016 | Anthony et al. |
| 9,267,157 B2 | 2/2016 | Anthony et al. |
| 9,273,330 B2 | 3/2016 | Bramucci et al. |
| 9,284,612 B2 | 3/2016 | Liao et al. |
| 9,297,016 B2 | 3/2016 | Flint et al. |
| 9,297,028 B2 | 3/2016 | Donaldson et al. |
| 9,297,029 B2 | 3/2016 | Donaldson et al. |
| 9,303,225 B2 | 4/2016 | Donaldson et al. |
| 9,365,872 B2 | 6/2016 | Donaldson et al. |
| 9,388,392 B2 | 7/2016 | Govindarajan et al. |
| 9,404,117 B2 | 8/2016 | Anthony |
| 9,422,582 B2 | 8/2016 | Anthony et al. |
| 2003/0166179 A1 | 9/2003 | Rajgarhia et al. |
| 2004/0038268 A1 | 2/2004 | Pirrung et al. |
| 2007/0031918 A1 | 2/2007 | Dunson et al. |
| 2008/0293125 A1 | 11/2008 | Subbian et al. |
| 2009/0081746 A1 | 3/2009 | Liao et al. |
| 2009/0162911 A1 | 6/2009 | Larossa et al. |
| 2009/0305369 A1 | 12/2009 | Donaldson et al. |
| 2010/0081154 A1 | 4/2010 | Flint et al. |
| 2010/0081182 A1 | 4/2010 | Paul et al. |
| 2010/0093020 A1 | 4/2010 | Bramucci et al. |
| 2010/0120105 A1 | 5/2010 | Anthony et al. |
| 2010/0221802 A1 | 9/2010 | Grady et al. |
| 2011/0039327 A1 | 2/2011 | Winkler et al. |
| 2011/0076733 A1 | 3/2011 | Urano et al. |
| 2011/0136193 A1 | 6/2011 | Grady et al. |
| 2011/0195505 A1 | 8/2011 | Euler et al. |
| 2011/0244536 A1 | 10/2011 | Nagarajan et al. |
| 2011/0287500 A1 | 11/2011 | Urano et al. |
| 2011/0294179 A1 | 12/2011 | Grady et al. |
| 2012/0034666 A1 | 2/2012 | Hawkins et al. |
| 2012/0058541 A1 | 3/2012 | Alsaker et al. |
| 2012/0149080 A1 | 6/2012 | Bramucci et al. |
| 2012/0196341 A1 | 8/2012 | Donaldson et al. |
| 2012/0258873 A1 | 10/2012 | Gibson et al. |
| 2013/0035515 A1 | 2/2013 | Dobson et al. |
| 2013/0252296 A1* | 9/2013 | Maggio-Hall ... C12Y 401/0100 435/160 |
| 2014/0030782 A1 | 1/2014 | Anthony et al. |
| 2014/0030783 A1 | 1/2014 | Anthony et al. |
| 2014/0038263 A1 | 2/2014 | Flint et al. |
| 2014/0051137 A1 | 2/2014 | Flint et al. |
| 2014/0093930 A1 | 4/2014 | Li et al. |
| 2014/0141479 A1 | 5/2014 | Anthony et al. |
| 2014/0170732 A1 | 6/2014 | Bramucci et al. |
| 2014/0186911 A1 | 7/2014 | Anthony et al. |
| 2014/0273116 A1 | 9/2014 | Kelly et al. |
| 2014/0273129 A1 | 9/2014 | Bhalla et al. |
| 2014/0273130 A1 | 9/2014 | Anthony et al. |
| 2014/0349349 A1 | 11/2014 | Dauner et al. |
| 2014/0377824 A1 | 12/2014 | Satagopan et al. |
| 2015/0037855 A1 | 2/2015 | Bhadra et al. |
| 2015/0111269 A1 | 4/2015 | Li et al. |
| 2015/0125920 A1 | 5/2015 | Anthony et al. |
| 2015/0218595 A1 | 8/2015 | Bhadra et al. |
| 2015/0240267 A1 | 8/2015 | Anthony et al. |
| 2016/0024534 A1 | 1/2016 | Anthony et al. |
| 2016/0130612 A1 | 5/2016 | Anthony et al. |
| 2016/0138050 A1 | 5/2016 | Bramucci et al. |
| 2016/0222370 A1 | 8/2016 | Anthony et al. |
| 2016/0319307 A1 | 11/2016 | Nagarajan et al. |
| 2016/0326551 A1 | 11/2016 | Van Dyk et al. |
| 2016/0326552 A1 | 11/2016 | Dauner et al. |

FOREIGN PATENT DOCUMENTS

| | | |
|---|---|---|
| WO | WO2006059111 | 6/2006 |
| WO | WO2007020992 | 2/2007 |
| WO | WO2007106524 | 9/2007 |
| WO | WO2008098227 | 8/2008 |
| WO | WO2009086423 | 7/2009 |
| WO | WO2009149270 | 12/2009 |
| WO | WO2011019894 | 2/2011 |
| WO | WO2011066356 | 6/2011 |
| WO | WO2011103300 | 8/2011 |
| WO | WO2013102147 | 7/2013 |
| WO | WO2013142338 | 9/2013 |

OTHER PUBLICATIONS

Arthur, et al., Contribution of VanY D,D-Carboxypeptidase to Glycopeptide Resistance in Enterococcus faecalis by Hydrolysis of Peptidoglycan Precursors, Antimicrob. Agents Chemother. 38:1899-1903, 1994.

Wycoff, et al., Characterization and sequence analysis of a stable cryptic plasmid from Enterococcus faecium 226 and development of a stable cloning vector, Appl. Environ. Microbiol. 62:1481-1486, 1996.

Zirkle, et al., Analysis of a 108-kb region of the Saccharopolyspora spinosa genome covering the obscurin polyketide synthase locus, DNA Sequence 15:123-134, 2004.

Dickinson, et al., An investigation of the metabolims of valine to isobutyl alcohol in Saccharomyces cerevisiae, J. Biol. Chem. 273: 25751-25756, 1998.

Durre, New insights and novel developments in clostridal acetone/butanol/isopropanol fermentation, Appl. Microbial. Biotechnol. 49:639-648, 1998.

Eden, et al., Involvement of branched-chain amino acid aminotransferases in the production of fusel alcohols during fermentation in yeast, Appl. Microbiol. Biotechnol. 55:296-300, 2001.

Eichenbaum, et al., Use of the Lactococcal nisA promoter to regulate gene expression in gram-positive bacteria: comparison of induction level and promoter strength Appl. Environ. Microbiol. 64:2763-2769, 1998.

Flint, et al., Dihydroxy acid dehydratase from spinach contains a [2Fe-2S] cluster, J Biol. Chem. 263:3558-3564, 1988.

Flint, et al., Studies on the active site of dihydroxy-acid dehydratase, Bioorganic Chem. 21:367-385, 1993.

Flint, et al., The Inactivation of Fe-S Cluster Containing Hydrolyases by Superoxide, J. Biol. Chem. 268:22369-22376, 1993.

Fujimoto, et al., pAM401-Based Shuttle Vectors That Enable Overexpression of Promoterless Genes and One-Step Purification of Tag Fusion Proteins Directly from Enterococcus faecalis, Appl. Environ. Microbiol. 67:1262-1267, 2001.

Godon, et al., Branched-chain amino acid biosynthesis genes in Lactococcus lactis subsp. lactis, J. Bacterial. 174:6580-6589, 1992.

Gossens, et al., Control of diacetyl formation by the intensification of the anabolic flux of acetohydroxyacid intermediates, European Brewery Convention: Proceedings of the 21st Congress, Madrid, 1987, pp. 553-560.

Groot, et al.,Technologies for butanol recovery integrated with fermentations, Process. Biochem. 27:61-75, 1992.

(56) References Cited

OTHER PUBLICATIONS

Horton, et al., Engineering hybrid genes without the use of restriction enzymes: gene splicing by overlap extension, Gene 77:61-68, 1989.
Imlay, Iron-sulphur clusters and the problem with oxygen, Mol. Microbial. 59:1073-1082, 2006.
Kim, et al., Catalytic promiscuity in dihydroxy-acid dehydratase from the thermoacidophilic archaean Sulfotobus solfataricus, J. Biochem, 139: 591-596, 2006.
Kleerbezem, et al., Controlled Gene Expression Systems for Lactic Acid Bacteria: Transferable Nisin-Inducible Expression Cassettes for *Lactococcus, Leuconostoc*, and *Lactobacillus* spp. Appl. Environ. Microbiol. 63:4581-4584, 1997.
Maguin, et al., New thermosensitive plasmid for gram-positive bacteria, J. Bacteriol, 174:5633-5638, 1992.
Methods in Yeast Genetics, 2005, Cold Spring Harbor Laboratory Press, Cold Spring Harbor, NY, pp. 201-202.
O'Sullivan, et al., High- and low-copy-number Lactococcus shuttle cloning vectors with features for clone screening, Gene 137:227-231, 1993.
Polaina, Cloning of the IL V2, IL V3 and IL V 5 Genes of *Saccharomyces cerevisiae*, Carlsberg Res. Commun., 49:577-584, 1984.
Renault, et al., Plasmid vectors for gram-positive bacteria switching from high to low copy number, Gene 183:175-182, 1996.
Rud, et al., A synthetic promoter library for constitutive gene expression in Lactobacillus plantarum, Microbiology 152:1011-1019, 2006.
Rupp, et al., Electron spin relaxation of iron-sulfur proteins studied by microwave power saturation, Biochim. Biophys. Acta 537:255-269, 1978.
Scott, et al., Sequences of versatile broad-host-range vectors of the RK2 family, Plasmid 50:74-79, 2003.
Seffernick, et al., Melamine deaminase and atrazine chlorohydrolase: 98 percent identical but functionally different, J. Bacterial. 183:2405-2410, 2001.
Sorvig, et al., Plasmid p256 from Lactobacillus plantarum represents a new type of replicon in lactic acid bacteria, and contains a toxin-antitoxin-like plasmid maintenance system, Microbiology 151:421-431, 2005.
Tanimoto, et al., Analysis of the Conjugal Transfer System of the Pheromone-Independent Highly Transferable Enterococcus Plasmid pMG1: Identification of a tra Gene (traA) Up-Regulated during Conjugation, J. Bacteriol. 184:5300-5304, 2002.
Thompson, et al., Clustal W: improving the sensitivity of progressive multiple sequence alignment through sequence weighting, position-specific gap penalties and weight matrix choice, Nucleic Acids Research 22:4673-4680, 1994.
van Kranenburg, et al., Functional Analysis of Three Plasmids from Lactobacillus plantarum, Appl. Environ. Microbiol. 71:1223-1230, 2005.
Villa, et al., Control of Vicinal Diketone Production by Brewer's Yeast. I. Effects of ilv5 and IL V3 Gene Amplification on Vicinal Diketone Production and IL V Enzyme Activity, Journal of the American Society of Brewing Chemists, 53:49-53, 1995.
Watanabe, et al., Identification and characterization of L-Arabonate dehydratase, L-2-keto-3-deoxyarabonate dehydratase, and L-Arabinolactonase involved in an alternative pathway of L-Arabinose metabolism, J. Biol. Chem. 281:33521-3353, 2006.
Branden, et al., Introduction to Protein Structure, Garland Publishing Inc., New York p. 247, 1991.
Gellissen, et al., Heterologous protein production in yeast, Antonie van Leeuwenhoek 62:79-93, 1992.
Harashima, et al., Heterologous Protein Production by Yeast Host-Vector Systems, Biopress technol. 19:137-158, 1994.
Mendoza-Vega, et al., Industrial production of heterologous proteins by fed-batch cultures of the yeast *Saccharomyces cerevisiae*, FEMS Microbiol. Rev. 15:369-410, 1994.
Roggenkamp, et al., Expression and processing of bacterial 8-lactamase in the yeast *Saccharomyces cerevisiae*, Proc. Natl. Acad. Sci. USA 78:4466-4470, 1981.
Romanos, et al., Foreign Gene Expression in Yeast: a Review, Yeast 8: 423-488, 1992.
Russell, et al., Production of Recombinant Products in Yeast: A Review, Australian J. Biotechol. 5:48-55, 1991.
Chica, et al., Semi-rational approaches to engineering enzyme activity: combining the benefits of directed evolution and rational design, Curr. Opin. Biotechnol. 16:378-384, 2005.
Johnson, et al., Structure, Function, and Formation of Biological Iron-Sulfur Clusters, Ann. Rev. Biochem. 74:247-281, 2005.
Chen, et al., Role of NifS in maturation of glutamine phosphoribosylpyrophosphate amidotransferase, J. Bacteriol. 179:7587-7590, 1997.
Flint, *Escherichia coli* Contains a Protein That Is Homologous in Function and N-terminal Sequence to the Protein Encoded by the nifS Gene of Azotobacter vinelandii and That Can Participate in the Synthesis of the Fe-S Cluster of Dihydroxy-acid Dehydratase, J. Biol. Chem. 271:16068-16074, 1996.
Ui, et al., Production of L-2,3-butanediol by a new pathway constructed in *Escherichia coli*, Lett. Appl. Microbiol. 39:533-537, 2004.
Karlin, et al., Comparative analysis of gene expression among low G+C gram-positive genomes, Proc. Natl. Acad. Sci USA 101:6182-6187, 2004.
Henriksen, et al., Redirection of pyruvate catabolism in Lactococcus lactis by selection of mutants with additional growth requirements, Appl. Microbiol. Biotechnol. 56:767-775, 2001.
Neves, et al. Metabolic characterization of Lactococcus lactis deficient in lactate dehydrogenase using in vivo 13CNMR, Eur. J. Biochem. 267:3859-3868, 2000.
Chen, PhD. Thesis, McGill University, Montreal, Canada, Formation and Analysis of Fusel Alcohols in Beer, 1978.
Broun, et al., Catalytic Plasticity of Fatty Acid Modification Enzymes Underlying Chemical Diversity of Plant Lipids, Science 282:1315-1317, 1998.
Devos, et al. Practical Limits of Function Prediction, Proteins: Structure, Function and Genetics 41:98-107, 2000.
Kisselev, Polypeptide Release Factors in Prokaryotes and Eukaryotes: Same Function, Different Structure, Structure 10:8-9, 2002.
Madera, et al., A comparison of profile hidden Markov model procedures for remote homology detection, Nuc. Acids Res. 30:4321-4328, 2002.
Sen, et al. Developments in Directed Evolution for Improving Enzyme Functions, Appl. Biochem. Biotechnol. 143:212-223, 2007.
Stanke, et al., Gene prediction with hidden Markov model and a new intron submodel, Bioinformatics 19 Suppl.2: 215-225, 2003.
Whisstock, et al., Prediction of protein function from protein sequence and structure, Quarterly Reviews of Biophysics 36:307-340, 2003.
Wishart, et al., A Single Mutation Converts a Novel Phosphotyrosine Binding Domain into a Dual-specificity Phosphate, J. Biol. Chem. 270:26782-26785, 1995.
Witkowski, et al., Conversion of a beta-Ketoacyl Synthase to a Malonyl Decarboxylase by Replacement of the Active-Site Cysteine with Glutamine, Biochem. 38:11643-11650, 1999.
Chen, et al., Inhibition of Fe-S cluster biosynthesis decreases mitochondrial iron export: Evidence that Yfh1p affects Fe-S cluster synthesis, Proc. Natl. Acad. Sci. 99:12321-12326, 2002.
Jensen, et al., Role of *Saccharomyces cerevisiae* ISA1 and ISA2 in Iron Homeostasis, Mol. Cell Biol. 20:3918-3927, 2000.
Nakamura, et al., Hyperproduction of Recombinant Ferredoxins in *Escherichia coli* by Coexpression of the ORF1-ORF2-iscS-iscU-iscA-hscB-hscA-fdx-ORF3 Gene Cluster, J. Biochem. 126:10-18, 1999.
Garland, et al., *Saccharomyces cerevisiae* ISU1 and ISU2: Members of a Well-conserved Gene Family for Iron-Sulfur Cluster Assembly, J. Mol. Biol. 294:897-907,1999.
Altschul, et al., Basic Local Alignment Search Tool, J. Mol. Biol. 215:403-410, 1990.

(56) References Cited

OTHER PUBLICATIONS

Flint, et al., The role and properties of the iron-sulfur cluster in *Escherichia coli* dihydroxy-acid dehydratase. J. Biol. Chem. 268:14732-14742, 1993.

Deshpande, et al., Ethanol Production from Cellulose by Coupled Saccharification/Fermentation using *Saccharomyces cerevisiae* and Cellulase Complex from Sclerotium rolfsii UV-8 Mutant, Appl. Biochem, Biotechnol. 36:227-234, 1992.

Frohman, et al., Rapid production of full-length cDNAs from rare transcripts: Amplification using a single gene-specific oligonucleotide primer, Proc. Natl. Acad. Sci. 85:8998-9002, 1988.

Guo, et al. Pervaporation study on the dehydration of aqueous butanol solution: a comparison of flux vs. permeance, separation factor vs. selectivity, J. Membrane Sci. 245:199-210, 2004.

Hartmanis, et al., Diol Metabolism and Diol Dehydratase in *Clostridium glycolicum*, Arch. Biochem. Biophys. 245:144-152, 1986.

Higgins, et al., Fast and sensitive multiple sequence alignments on a microcomputer, CABIOS Communications 5:151-153, 1989.

Higgins, et al., CLUSTAL V: improved software for multiple sequence alignment, CABIOS 8:189-191, 1992.

Krogh, et al., Hidden Markov Models in Computational Biology, J. Mol. Biol. 235:1501-1531, 1994.

Loh, et al., Polymerase Chain Reaction with Single-Sided Specificity: Analysis of T Cell Receptor Gamma Chain, Science 243:217-220, 1989.

Mnaimneh, et al., Exploration of Essential Gene Functions via Titratable Promoter Alleles, Cell 118:31-44, 2004.

O'Brien, et al., Insight into the Mechanism of the B12-Independent Glycerol Dehydratase from *Clostridium butyricum*: Preliminary Biochemical and Structural Characterization, Biochemistry 43:4635-4645, 2004.

O'Hara, et al. One-sided polymerase chain reaction: The amplification of cDNA, Proc. Natl. Acad. Sci. 86:5673-5677, 1989.

Scott, et al., Whole-Genome Transcription Profiling Reveals Genes Up-Regulated by Growth on Fucose in the Human Gut Bacterium "Roseburia inulinivorans," J. Bacteriol. 188:4340-4349, 2006.

Sulter, et al., Proliferation and metabolic significance of peroxisomes in Candida boidinii during growth on o-alanine or oleic acid as the sole carbon source, Arch. Microbiol. 153:485-489, 1990.

Tabor, et al., A bacteriophage T7 RNA polymerase/promoter system for controlled exclusive expression of specific genes, Proc. Natl. Acad. Sci. 82:1074-1078, 1985.

Van Ness, et al., The use of oligodeoxynucleotide probes in chaotrope-based hybridization solutions, Nucl. Acid Res. 19:5143-5151, 1991.

Wach, et al., New Heterologous Modules for Classical or PCR-based Gene Disruptions in *Saccharomyces cerevisiae*, Yeast 10:1793-1808, 1994.

Walker, et al., Isothermal in vitro amplification of DNA by a restriction enzyme/DNA polymerase system, Proc. Natl. Acad. Sci. 89:392-396, 1992.

Aden, et al. Lignocellulosic Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, Jun. 2002.

Flint, et al., The Inactivation of Dihydroxy-acid Dehydratase in *Escherichia coli* Treated with Hyperbaric Oxygen Occurs Because of the Destruction of Its Fe-S Cluster, but the Enzyme Remains in the Cell in a FormThat Can Be Reactivated, J. Biol. Chem. 268:25547-25552, 1993.

Bellion; et al., Microb. Growth C1 Compd., [Int. Symp.], 7th (1993), 415 32. Editor(s): Murrell, J. Collin; Kelly, Don P. Publisher: Intercept, Andover, UK.

Connor, et al., Engineering of an *Escherichia coli* Strain for the Production of 3-Methyl-1-Butanol, Appl. Environ. Microbiol. 74:5769-5775, 2008.

Malkin, et al., The Reconstitution of Clostridial Ferredoxin, Biochem. Biophys. Res. Comm. 23:822-827, 1996.

Liu, et al., Electron Paramagnetic Resonance Evidence for a Novel Interconversion of [3Fe-4S] and [4Fe-4S] Clusters with Endogenous Iron and Sulfide in Anaerobic Ribonucleotide Reductase Activase in Vitro, J. Biol. Chem. 275:12367-12373, 2000.

Tokumoto, et al., Genetic analysis of the isc operon in *Escherichia coli* involved in the biogenesis of cellular iron sulfur proteins, J. Biochem. 130:63-71, 2001.

Fontecave, et al., Mechanisms of iron-sulfur cluster assembly; the SUF machinery, J. Biol. Inorganic Chem. 10:713-721, 2005.

Elli, et al., Iron requirement of *Lactobacillus* spp. In completely chemically defined growth media, J. Appl. Microbiol. 88:695-703, 2000.

Hebert, et al., Nutritional Requirements of *Lactobacillus delbrueckii* subsp. *lactis* in a Chemically Defined Medium. Curr. Microbiol. 49:341-345, 2004.

Duhutrel, et al., Iron Sources Used by the Nonpathogenic Lactic Acid Bacterium Lactobacillus sakei as Revealed by Electron Energy Loss Spectroscopy and Secondary-Ion Mass Spectrometry, Appl. Environ. Microbiol. 76:560-565, 2009.

Rychlik, In Methods in Molecular Biology, White, B. A. Ed., (1993) vol. 15, pp. 31 39, PCR Protocols: Current Methods and Applications. Humania: Totowa, NJ.

Sambrook, et al., Molecular Cloning: A Laboratory Manual, 2nd ed., Cold Spring Harbor Laboratory: Cold Spring Harbor, NY (1989).

Imbert, et al. On the Iron Requirement of Lactobacilli Grown in Chemically Defined Medium, Curr. Microbiol, 37:64-66, 1998.

Pandey, et al., Iron requirement and search for siderophores in lactic acid bacteria, Appl. Microbiol. Biotechnol. 40:735-739, 1994.

Archibald, Lactobacillus plantarum, an organism not requiring iron, FEMS Microbiol. Lett. 19:29-32, 1983.

Shrago, et al.,Conjugal Plasmid Transfer (pAMb1) in Lactobacillus plantarum, Appl. Environ. Microbiol. 52:574-576, 1986.

Thein, et al., "The use of oligonucleotides as specific hybridization probes in the Diagnosis of Genetic Disorders," in Human Genetic Diseases: A Practical Approach, K. E. Davis Ed., (1986) pp. 33 50, IRL: Herndon, VA.

Cruz-Rodz, et al., High efficiency introduction of plasmid DNA into glycine treated Enterococcus Faecalis by electroporation, Mol. Gen. Gent. 224:152-154, 1990.

W. R. Pearson, Comput. Methods Genome Res., [Proc. Int. Symp.] (1994), Meeting Date 1992, 111-120.

Velasco, et al., Cloning of the dihydroxyacid dehydratse-encoding gene (ILV3) from *Saccharomyces cerevisiae*, Gene 137:179-185, 1993.

Casey, Cloning and Analysis of Two Alleles of the ILV3 Gene from *Saccharomyces cerevisiae*, Carlsberg Research Communications 51:327-341, 1986.

Guo, et al., Protein tolerance to random amino acid change, Proc. Natl. Acad. Sci. 101:9205-9210, 2004.

Lazar, et al., Transforming Growth Factor alpha: Mutation of Aspartic Acid 47 and Leucine 48 Results in Different Biological Activity Mol. Cell Biol. 8:1247-1252, 1988.

Hill, et al., Functional Analysis of Conserved Histidines in ADP-Glucose Pyrophosphorylase from *Escherichia coli*, Biochem. Biophys. Res. Comm. 244:573-577, 1998.

Wacey, et al., Disentangling the perturbational effects of amino acid substitutions in DNA-binding domin of p53, Human Genetics 104:15-22, 1999.

Goldberg, et al., Localization and functionality of microsporidian iron-sulphur cluster assembly proteins, Nature 452:624-628, 2008.

Flint, et al., Studies on the synthesis of the Fe-S cluster of dihydroxy-acid dehydratase in *Escherichia coli* crude extract, J. Biol. Chem. 271:16053-16067, 1996.

Bandyopadhyay, et al., A Proposed Role for the Azotobacter vinelandii NfuA Protein as an Intermediate Iron-Sulfur Cluster Carrier, J. Biol. Chem. 283:14092-14099, 2008.

Foury, et al., Mitochondrial Control of Iron Homeostasis, J. Biol. Chem. 276:7762-7768, 2001.

Gerber, et al., The Yeast Scaffold Proteins Isu1p and Isu2p Are Required Inside Mitochondria for Maturation of Cytosolic Fe/S Proteins, Mol. Cell. Biol. 24:4848-4857, 2004.

(56) References Cited

OTHER PUBLICATIONS

Gupta, et al., Native *Escherichia coli* SufA, Coexpressed with SufBCDSE, Purifies as a [2Fe-2S] Protein and Acts as an Fe-S Transporter to Fe-S Target Enzymes, J. Am. Chem. Soc. 131:6149-6153, 2009.
Kaplan, et al., Iron Acquisition and Transcriptional Regulation, Chem. Rev. 109:4536-4552, 2009.
Kim, et al., Transposable Elements and Genome Organization: A Comprehensive Survey of Retrotransposons Revealed by the Complete *Saccharomyces cervisiae* Genome Sequence, Genome Res. 8:464-478, 1998.
Kumanovics, et al., Identification of FRA1 and FRA2 as Genes Involved in Regulating the Yeast Iron Regulon in Response to Decreased Mitochondrial Iron-Sulfur Cluster Synthesis, J. Biol. Chem. 283:10276-10286, 2008.
Li, et al., The Yeast iron Regulatory Proteins Grx3/4 and Fra2 Form Heterodimeric Complexes Containing a [2Fe-2S] Cluster with Cysteinyl and Histidyl Ligation, Biochemistry 48:9569-9581, 2009.
Li, et al., CCC1 Is a Transporter That Mediates Vacuolar Iron Storage in Yeast, J. Biol. Chem. 276:29515-29519, 2001.
Liu, et al., Iron-Sulfur Cluster Biosynthesis: Functional Characterization of the N- and C-Terminal Domains of Human NFU, Biochemistry 48:973-980, 2009.
Nakamura, et al., Codon usage tabulated from international DNA sequence databases: status for the year 2000, Nuc. Acids Res. 28:292, 2000.
Ojeda, et al., Role of Glutaredoxin-3 and Glutaredoxin-4 in the Iron Regulation of the Aft1 Transcriptional Activator in *Saccharomyces cervisiae*, J. Biol. Chem. 281:17661-17669, 2006.
Pujol-Carrion, et al., Glutaredoxins Grx3 and Grx4 regulate nuclear localisation of Aft1 and the oxidative stress response in *Saccharomyces cerevisiae*, J. Cell Sci. 19:4554-4564, 2006.
Rutherford, et al., Activation of the Iron Regulon by the Yeast Aft1/Aft2 Transcription Factors Depends on Mitochondrial but Not Cytosolic Iron-Sulfur Protein Biogenesis, J. Biol. Chem. 280:10135-10140, 2005.
Shakoury-Elizeh, et al., Transcriptional Remodeling in Response to Iron Deprivation in *Saccharomyces cerevisiae*, Mol. Biol. Cell 15:1233-1243, 2004.
Ueta, et al., Pse1p Mediates the Nuclear Import of the Iron-responsive Transcription Factor Aft1p in *Saccharomyces cerevisiae*, J. Biol. Chem. 278:50120-50127, 2003.
Yamaguchi-Iwai, et al., Subcellular Localization of Aft1 Transcription Factor Responds to Iron Status in *Saccharomyces cerevisiae*, J. Biol. Chem. 277:18914-18918, 2002.
Yamaguchi-Iwai, et al., AFT1: a mediator of iron regulated transcriptional control in *Saccharomyces cerevisiae*, EMBO J. 14:1231-1239, 1995.
Tan et al., IscA/SufA paralogues are required for the [4Fe-4S] cluster assembly in enzymes of multiple physiological pathways in *Escherichia coli* under aerobic growth conditions, Biochem. J. 420:463-472, 2009.
Lill, et al., Maturation of Iron-Sulfur Proteins in Eukaryotes: Mechanisms, Connected Processes, and Diseases, Ann. Rev. Biochem, 77:669-700, 2008.
Ryan, et al., Subcellular Localization of Isoleucine-Valine Biosynthetic Enzymes in Yeast, J. Bacteriol. 120:631-637, 1974.
Askwith, et al., The FET3 Gene of *S. cerevisiae* Encodes a Multicopper Oxidase Required for Ferrous Iron Uptake, Cell 76:403-410,1994.
Armstrong, et al., Stereoselectivity and Stereospecificity of the alpha, beta-Dihydroxy Acid Dehydratase from *Salmonella typhimurium*, Biochimica et Biophysica Acta 493:282-293, 1977.
Armstrong, Stereochemistry of the Reductoisomerase and alpha, beta-Dihydroxyacid Dehydratase-catalysed Steps in Valine and Isoleucine Biosynthesis. Observation of a Novel Tertiary Ketol Rearrangement, J.C.S. Chem. Comm. 9:351-352, 1974.
Armstrong, et al., Structure-Activity Studies with the alpha, beta-Dihydroxyacid Dehydratase of *Salmonella typhimuriurn*, J. Chem. Soc. Perkin Trans. 1:691-696, 1985.

Atsumi, et al., Metabolic engineering for advanced biofuels production from *Escherichia coli*, Curr. Opin. Biotechnol. 19:414-419, 2008.
Casas, et al., The AFTI Transcriptional Factor is Differentially Required for Expression of High-Affinity Iron Uptake Genes in *Saccharomyces cerevisiae*, Yeast 13:621-637, 1997.
Coleman, et al. Branched-chain Amino-acid Aminotransferase of *Salmonella typhimurium*: I. Crystallization and Preliminary Characterization, Biochimica et Biophysica Acta 227:56-66, 1971.
Conde, et al., KlAft, the Kluyveromyces lactis Ortholog of Aft I and Aft2, Mediates. Activation of Iron-Responsive Transcription Through the PuCACCC Aft-Type Sequence, Genetics 183:93-106, 2009.
Hausmann, et al., The eukaryotic P loop NTPase Nbp35: An essential component of the cytosolic and nuclear iron-sulfur protein assembly machinery, Proc. Natl. Acad Sci. 102:3266-3271, 2005.
Holatko, et al., Metabolic engineering of the L-valine biosynthesis pathway in Corynebacterium glutamicum using promoter activity modulation, J. Biotechnol, 139:203-210, 2009.
Ihrig, et al., Iron Regulation through the Back Door: Iron-Dependent Metabolite Levels Contribute to Transcriptional Adaptation to Iron Deprivation in *Saccharomyces cerevisiae*, Eukaryotic Cell 9:460-471, 2010.
Mercier, et al., Both Php4 Function and Subcellular Localization Are Regulated by Iron via a Multistep Mechanism Involving the Gluaredoxin Grx4 and the Exportin Crm 1, J. Biol. Chem. 284:20249-20262, 2009.
Mohlenhoff, et al., Cytosolic Monothiol Glutaredoxins Function in Intracellular Iron Sensing and Trafficking via Their Bound Iron-Sulfur Cluster, Cell Metabolism 12:373-385, 2010.
Ojeda, Iron Sensing in the Model Organism *Saccharomyces cerevisiae*, A dissertation submitted to the faculty of the University of Utah in partial fulfillment of the requirements for the degree of Doctor of Philosophy, The University of Utah, United States (2006).
Puig, et al., Coordinated Remodeling of Cellular Metabolism during Iron Deficiency through Targeted mRNA Degradation, Cell 120:99-110, 2005.
Rutherford, et al., A second iron-regulatory system in yeast independent of Aft1p, Proc. Natl. Acad. Sci. 98 (25):14322-14327, 2001.
Rutherford, et al., Aft1p and Aft2p Mediate iron-responsive Gene Expression in Yeast through Related Promoter Elements, J. Biol. Chem. 278:27636-27643, 2003.
Seguin, et al., Overexpression of the yeast frataxin hornolog (Yfh1): Contrasting effects on iron-sulfur cluster assembly, heme synthesis and resistance to oxidative stress, Mitochondrion 9:130-138, 2009.
Stemmler, et al., Frataxin and Mitochondrial FeS Cluster Biogenesis, J. Biol. Chem. 285:26737-26743, 2010.
Twarog, Enzymes of the Isoleucine-Valine Pathway in Acinetobacter, J. Bacteriol. 111:37-46, 1972.
Wixom, et al., A Rapid Determination of Dihydroxyacid Dehydratase Activity in Microbial Cell Suspensions, Anal. Biochem. 42:262-274, 1971.
Xing, et al., Characterization of Enzymes of the Branched-Chain Amino Acid Biosynthetic Pathway in *Methanococcus* spp., J. Bacteriol. 173:2086-2092, 1991.
Alegre, et al., Transformation of Lactobacillus plantarum by electroporation with in vitro modified plasmid DNA, FEMS Microbiol. Lett. 241:73-77, 2004.
Bringel, et al., Optimized transformation by electroporation of Lactobacillus plantarum strains with plasmid vectors, Appl. Microbiol. Biotechnol. 33:664-670, 1990.
Ferain, et al., *Lactobacillus plantarum* ldhL gene: Overexpression and Deletion, J. Bact. 176:596, 1994.
Hols, et al., Use of Homologous Expression-Secretion Signals and Vector-Free Stable Chromosomal Integration in Engineering of Lactobacillus plantarum for oL-Amylase and Levanase Expression, Appl. Environ. Microbiol. 60:1401-1403, 1994.
Horinouchi, et al., Nucleotide Sequence and Functional Map of pE194, a Plasmid That Specifies Inducible Resistance to Macrolide, Lincosamide, and Streptogramin Type B Antibiotics, J. Bacteriol. 150:804-814, 1982.
Jang, et al., New integration vector using a cellulase gene as a screening marker for Lactobacillus, Micro. Lett. 24:191-195, 2003.

(56) References Cited

OTHER PUBLICATIONS

UniProtKB/Swiss-Prot: Q8DRT7, Dihydroxy-acid dehydratase, ILVD_STRUM, Streptococcus mutans, Feb. 22, 2012.
GenBank ADA64951, Dihydroxy-acid dehydratase [*Lactococcus lactis* subsp. *lactis* KF147], Jan. 30, 2014.
NCBI Reference Sequence: WP_011676306 (formerly YP_809259) Dihydroxy-acid dehydratase [*Lactococcus lactis* subsp, *cremoris* SK11], Apr. 27, 2015.
GenBank AF508808, Lactobacillus plantarum plasmid pLF1 putative integrase/recombinase, ISLP1 transposase, and cold shock protein genes, complete cds, Jun. 24, 2002.
GenBank ABH11633, Putative ABC transporter ABC5MC5 [Lactobacillus helveticus CNRZ32], Jun. 14, 2007.
UniProtKB/Swiss-Prot: Q1WS05, Iron-sulfur cluster assembly/repair protein Lactobacillus salivarius UCC118, Oct. 31, 2006.
UniProt E1TL94, Cysteine desulfurase, Lactobacillus plantarum, Feb. 22, 2012.
UniProt E1TPR8, NifU-like protein, Lactobacillus plantarum, Feb. 22, 2012.
NCBI Reference Sequence: NC_004567, Lactobacillus plantarum WCFS1, complete genome, Mar. 25, 2015.
Re-examination of U.S. Pat. No. 8,241,878, U.S. Control No. 95/002,167, filed Sep. 10, 2012.
Re-examination of U.S. Patent No. 8,017,376, U.S. Control No. 95/001,870, filed Jan. 10, 2012.

\* cited by examiner

Figure 2

P-K-R-E-D-G-P-L-I-I-L  (SEQ ID NO:547)

DHAD VARIANTS FOR BUTANOL PRODUCTION

CROSS-REFERENCE TO RELATED APPLICATIONS

This application claims priority under 35 U.S.C. §119(e) to U.S. Provisional Patent Application No. 61/747,158, filed on Dec. 28, 2012; U.S. Provisional Patent Application No. 61/747,161, filed on Dec. 28, 2012; U.S. Provisional Patent Application No. 61/747,178, filed on Dec. 28, 2012; U.S. Provisional Patent Application No. 61/885,924, filed on Oct. 2, 2013; and U.S. Provisional Patent Application No. 61/885,939, filed on Oct. 2, 2013; all of which are incorporated herein by reference in their entireties.

REFERENCE TO SEQUENCE LISTING SUBMITTED ELECTRONICALLY

The content of the electronically submitted sequence listing (Name: 20131227_CL5837USNP_SequenceListing_ascii.txt; Size: 2,825,513 bytes; and Date of Creation: Dec. 27, 2013, filed herewith, is incorporated herein by reference in its entirety.

FIELD OF THE INVENTION

The present invention relates to the field of industrial microbiology and dihydroxy-acid dehydratase variants for production pathways, including isobutanol biosynthetic pathways, in microorganisms. For example, dihydroxy-acid dehydratase variants are disclosed and expressed as heterologous proteins in bacterial and yeast hosts.

BACKGROUND

Dihydroxy-acid dehydratase (DHAD), also called acetohydroxy acid dehydratase, catalyzes the conversion of 2,3-dihydroxyisovalerate to α-ketoisovalerate and of 2,3-dihydroxymethylvalerate to α-ketomethylvalerate. DHAD-catalyzed conversion of 2,3-dihydroxyisovalerate to α-ketoisovalerate is a common step in the multiple isobutanol biosynthetic pathways that are disclosed, for example, in U.S. Pat. No. 7,851,188. Disclosed therein is engineering of recombinant microorganisms for production of isobutanol. Isobutanol is useful as a fuel additive, and the availability of biologically-produced isobutanol can reduce the demand for petrochemical fuels.

BRIEF SUMMARY OF THE INVENTION

The present invention provides, for example, isolated polypeptides and fragments thereof having DHAD activity.

One aspect of the invention is directed to an isolated polypeptide or fragment thereof having DHAD activity, wherein the polypeptide or fragment thereof comprises an amino acid motif which is at least 90% identical to the amino acid sequence of SEQ ID NO:547, wherein the amino acid residue at position 2 of SEQ ID NO:547 is not isoleucine or leucine, and wherein the amino acid motif comprises one or more amino acid substitutions selected from: P1A, P1S, G6S, G6A, L8F, L8V, L8M, L8A, I10V, I10M, I10L, I10G, I10A, L11I, L11M, L11V, L11A, and L11F. In an embodiment of the invention, the amino acid residue at position 2 of SEQ ID NO:547 is lysine. In another embodiment, the amino acid motif comprises at least an amino acid substitution at I10V. In yet another embodiment, the amino acid motif comprises at least an amino acid substitution at L8V.

In another aspect, the invention is directed to an isolated polypeptide or fragment thereof having DHAD activity, wherein the polypeptide or fragment thereof comprises an amino acid motif which is at least 90% identical to the amino acid sequence of SEQ ID NO:548, wherein the amino acid motif comprises two or more amino acid substitutions selected from: P1A, P1S, G6S, G6A, L8F, L8V, L8M, L8A, I10V, I10M, I10L, I10G, I10A, L11I, L11M, L11V, L11A, and L11F. In an embodiment of the invention, the amino acid motif comprises the amino acid sequence of SEQ ID NO:553, SEQ ID NO:558, SEQ ID NO:563, SEQ ID NO:568, SEQ ID NO:573, SEQ ID NO:578, SEQ ID NO:583, or SEQ ID NO:588. In another embodiment, the polypeptide or fragment thereof having DHAD activity comprises the amino acid sequence of SEQ ID NO:550, SEQ ID NO:555, SEQ ID NO:560, SEQ ID NO:565, SEQ ID NO:570, SEQ ID NO:575, SEQ ID NO:580, or SEQ ID NO:585. In another embodiment, the polypeptide or fragment thereof having DHAD activity comprises the amino acid sequence of SEQ ID NO:565. In another embodiment, the amino acid motif comprises the amino acid sequence of SEQ ID NO:573.

In certain embodiments, 9 amino acids are deleted from the C-terminal end of the amino acid sequence of SEQ ID NO:550, SEQ ID NO:555, SEQ ID NO:560, SEQ ID NO:565, SEQ ID NO:570, SEQ ID NO:575, SEQ ID NO:580, or SEQ ID NO:585.

In certain embodiments, the polypeptide or fragment thereof having DHAD activity catalyzes the conversion of 2,3-dihydroxyisovalerate to α-ketoisovalerate or 2,3-dihydroxymethylvalerate to α-ketomethylvalerate.

In other embodiments, the isolated polypeptide or fragment thereof having DHAD activity further comprises a polycysteine or polyhistidine tag. In still other embodiments, the isolated polypeptide or fragment thereof having DHAD activity further comprises the amino acid sequence of SEQ ID NO:589.

In certain embodiments, the polypeptide or fragment thereof having DHAD activity is a [2Fe-2S]$^{2+}$ DHAD. In other embodiments, the polypeptide or fragment thereof having DHAD activity is a [4Fe-4S]$^{2+}$ DHAD. In still other embodiments, the polypeptide or fragment thereof having DHAD activity has an amino acid sequence that matches the Profile Hidden Markov Model (HMM) of Table 6 with an E value of <$10^{-5}$.

In another embodiment, the polypeptide or fragment thereof having DHAD activity comprises three conserved cysteines corresponding to positions 56, 129, and 201 in the amino acid sequences of the *Streptococcus mutans* DHAD corresponding to SEQ ID NO:544.

In other embodiments, the polypeptide or fragment thereof having DHAD activity is from a prokaryotic organism. In certain embodiments, the polypeptide or fragment thereof having DHAD activity is from bacteria, fungi, or plant. In a particular embodiment, the polypeptide or fragment thereof having DHAD activity is from *Streptococcus mutans*. Other sources of DHADs include, for example, *Streptococcus downei, Oscillatoria* species PCC 6506, *Zea mays, Lactococcus lactis, Neurospora crassa,* and *Streptooccus macacae.*

Another aspect of the invention is directed to an isolated nucleic acid molecule encoding a dihydroxy-acid dehydratase (DHAD), wherein the DHAD comprises an amino acid motif which is at least 90% identical to the amino acid sequence of SEQ ID NO:547, wherein the amino acid residue at position 2 of SEQ ID NO:547 is not isoleucine or leucine, and wherein the amino acid motif comprises one or more amino acid substitutions selected from: P1A, P1S, G6S, G6A, L8F, L8V, L8M, L8A, I10V, I10M, I10L, I10G, I10A, L11I, L11M, L11V, L11A, and L11F. In an embodiment of the invention, the amino acid residue at position 2 of SEQ ID NO:547 is lysine. In another embodiment, the amino acid motif comprises at least an amino acid substitution at I10V. In yet another embodiment, the amino acid motif comprises at least an amino acid substitution at L8V.

Another aspect of the invention is directed to an isolated nucleic acid molecule encoding a DHAD, wherein the DHAD comprises an amino acid motif which is at least 90% identical to the amino acid sequence of SEQ ID NO:548, wherein the amino acid motif comprises two or more amino acid substitutions selected from: P11A, P1S, G6S, G6A, L8F, L8V, L8M, L8A, I10V, I10M, I10L, I10G, I10A, L11I, L11M, L11V, L11A, and L11F. In some embodiments, the amino acid motif comprises the amino acid sequence of SEQ ID NO:553, SEQ ID NO:558, SEQ ID NO:563, SEQ ID NO:568, SEQ ID NO:573, SEQ ID NO:578, SEQ ID NO:583, or SEQ ID NO:588. In other embodiments, the DHAD encoded by the isolated nucleic acid molecule comprises the amino acid sequence of SEQ ID NO:550, SEQ ID NO:555, SEQ ID NO:560, SEQ ID NO:565, SEQ ID NO:570, SEQ ID NO:575, SEQ ID NO:580, or SEQ ID NO:565. In another embodiment, the DHAD encoded by the isolated nucleic acid molecule comprises the amino acid sequence of SEQ ID NO: 11. In other embodiments, 9 amino acids are deleted from the C-terminal end of the amino acid sequence of SEQ ID NO:550, SEQ ID NO:555, SEQ ID NO:560, SEQ ID NO:565, SEQ ID NO:570, SEQ ID NO:575, SEQ ID NO:580, or SEQ ID NO:585. In another embodiment, the DHAD encoded by the isolated nucleic acid molecule comprises the amino acid motif of SEQ ID NO:573.

In some embodiments, the DHAD encoded by the isolated nucleic acid molecule catalyzes the conversion of 2,3-dihydroxyisovalerate to α-ketoisovalerate. In other embodiments, the DHAD encoded by the nucleic acid molecule further comprises a polycysteine or polyhistidine tag. In another embodiment, the DHAD encoded by the nucleic acid further comprises the amino acid sequence of SEQ ID NO:589.

In some embodiments, the DHAD encoded by the isolated nucleic acid molecule is a $[2Fe-2S]^{2+}$ DHAD. In other embodiments, the DHAD encoded by the isolated nucleic acid molecule is a $[4Fe-4S]^{2+}$ DHAD. In other embodiments, the DHAD encoded by the isolated nucleic acid molecule has an amino acid sequence that matches the Profile Hidden Markov Model (HMM) of Table 6 with an E value of $<10^{-5}$.

In other embodiments, the DHAD encoded by the isolated nucleic acid molecule comprises three conserved cysteines corresponding to positions 56, 129, and 201 in the amino acid sequences of the *Streptococcus mutans* DHAD corresponding to SEQ ID NO:544.

In other embodiments, the DHAD encoded by the isolated nucleic acid molecule is from a prokaryotic organism. In other embodiments, the DHAD encoded by the isolated nucleic acid molecule is from bacteria, fungi, or plant. In a particular embodiment, the DHAD encoded by the isolated nucleic acid molecule is from *Streptococcus mutans*.

In some embodiments of the invention, the isolated nucleic acid molecule is operatively linked to a promoter sequence. In other embodiments, the isolated nucleic acid molecules of the invention are comprised in a vector.

The invention also provides polypeptides encoded by the isolated nucleic acid molecules described above.

Another aspect of the invention is directed to a recombinant host cell comprising the isolated nucleic acid molecules of the invention or a vector of the invention. In certain embodiments, the DHAD encoded by the isolated nucleic acid molecule is heterologous to the recombinant host cell. In other embodiments, the DHAD encoded by the isolated nucleic acid molecule is over-expressed in the recombinant host cell.

In still other embodiments, the recombinant host cell of the invention is a bacterial cell or a yeast cell. In some embodiments, the recombinant host cell of the invention is a bacterial cell, and the bacterial cell is a member of a genus of bacteria selected from *Clostridium, Zymomonas, Escherichia, Salmonella, Rhodococcus, Pseudomonas, Bacillus, Lactobacillus, Enterococcus, Pediococcus, Alcaligenes, Klebsiella, Paenibacillus, Arthrobacter, Corynebacterium, Brevibacterium, Lactococcus, Leuconostoc, Oenococcus, Pediococcus*, and *Streptococcus*. In other embodiments, the recombinant host cell of the invention is a yeast cell, and the yeast cell is a member of a genus of yeast selected from *Saccharomyces, Schizosaccharomyces, Hansenula, Kluyveromyces, Candida, Pichia,* and *Yarrowia*. In other embodiments, the recombinant host cell of the invention is *Saccharomyces cerevisiae, Schizosaccharomyces pombe, Kluyveromyces lactis, Kluyveromyces thermotolerans, Candida glabrata, Candida albicans, Pichia stipitis*, or *Yarrowia lipolytica*. In another embodiment, the recombinant host cell of the invention is *Saccharomyces cerevisiae*.

In some embodiments, the recombinant host cell of the invention is a yeast cell and the yeast cell further comprises a disruption in an endogenous ILV3 gene that encodes mitochondrial DHAD. In other embodiments, the yeast cell further comprises a disruption in one or more endogenous genes affecting iron-sulfur cluster biosynthesis selected from FRA2, GRX3, GRX4, and CCC1. In yet other embodiments, the yeast cell has been further genetically engineered to upregulate the activity of at least one gene selected from AFT1 and AFT2.

In some embodiments, the recombinant host cell of the invention is a bacterial cell, and the bacterial cell is a *Lactobacillus*. In other embodiments, the *Lactobacillus* further comprises at least one recombinant genetic expression element encoding iron-sulfur (Fe—S) cluster forming proteins. In yet other embodiments, the recombinant genetic expression element encoding iron-sulfur cluster forming proteins contains coding regions of an operon selected from Isc, Suf, and Nif operons. In some embodiments, the Suf operon comprises at least one coding region selected from SufC, SufD, SufS, SufU, SufB, SufA, and yseH. In some embodiments, the Suf operon is derived from *Lactococcus lactis* or *Lactobacillus plantarum*. In some embodiments, the Isc operon comprises at least one coding region selected from IscS, IscU, IscA, IscX, HscA, HscB, and Fdx. In some embodiments, the Isc operon is derived from *Escherichia coli*. In some embodiments, the Nif operon comprises at least one coding region selected from NifS and NifU. In some embodiments, the Nif operon is derived from *Wolinella succinogenes*.

In some embodiments, the recombinant host cell of the invention produces butanol, for example, isobutanol. In other embodiments, the recombinant host cell of the invention comprises an isobutanol biosynthetic pathway. In some embodiments, the isobutanol biosynthetic pathway comprises genes encoding acetolactate synthase, acetohydroxy acid isomeroreductase, DHAD, α-keto acid decarboxylase, and alcohol dehydrogenase. In another embodiment, the isobutanol biosynthetic pathway comprises the following substrate to product conversions: (i) pyruvate to acetolactate; (ii) acetolactate to 2,3-dihydroxyisovalerate; (iii) 2,3-dihydroxyisovalerate to α-ketoisovalerate; (iv) α-ketoisovalerate to isobutyraldehyde; and (v) isobutyraldehyde to isobutanol.

The substrate to product conversion of pyruvate to acetolactate can be catalyzed in some embodiments by an acetolactate synthase. The substrate to product conversion of acetolactate to 2,3-dihydroxyisovalerate can be catalyzed in some embodiments by a ketol-acid reductoisomerase. The substrate to product conversion of 2,3-dihydroxyisovalerate to α-ketoisovalerate can be catalyzed in some embodiments by the DHAD. The substrate to product conversion of α-ketoisovalerate to isobutyraldehyde can be catalyzed in some embodiments by an α-keto acid decarboxylase. The substrate to product conversion of isobutyraldehyde to isobutanol can be catalyzed in some embodiments by an alcohol dehydrogenase.

In some embodiments, two or more of: acetolactate synthase, ketol-acid reductoisomerase, and α-keto acid decarboxylase are heterologous to the recombinant host cell. In other embodiments, two or more of: acetolactate synthase, ketol-acid reductoisomerase, and α-keto acid decarboxylase are over-expressed in the recombinant host cell.

In some embodiments, the recombinant host cell comprising the isolated nucleic acid molecules of the invention produces an isobutanol titer that is increased as compared to a recombinant host cell that does not contain the amino acid substitutions. In some embodiments, the recombinant host cell comprising the isolated nucleic acid molecules produces isobutanol at a rate that is increased by at least about 10%, at least about 20%, at least about 30%, at least about 40%, or at least about 50% as compared to a recombinant host cell that does not contain the amino acid substitutions.

Another aspect of the invention is directed to a method for the production of butanol, for example, isobutanol, comprising providing a recombinant host cell comprising the isolated nucleic acid molecules of the invention; culturing the recombinant host cell in a fermentation medium under suitable conditions to produce isobutanol from pyruvate; and recovering the isobutanol. In some embodiments, the isobutanol is produced at a titer that is increased as compared to a recombinant host cell that does not contain the amino acid substitutions. In other embodiments, the isobutanol is produced at a rate that is increased by at least about 10%, at least about 20%, at least about 30%, at least about 40%, or at least about 50% as compared to a recombinant host cell that does not contain the amino acid substitutions. In another embodiment, the concentration of isobutanol in the fermentation medium is greater than or equal to about 50 mM.

Another aspect of the invention is directed to a method of converting 2,3-dihydroxyisovalerate to α-ketoisovalerate or 2,3-dihydroxymethylvalerate to α-ketomethylvalerate, comprising providing the isolated polypeptide or fragment thereof of the invention, wherein the isolated polypeptide or fragment thereof catalyzes the conversion of 2,3-dihydroxyisovalerate to α-ketoisovalerate or 2,3-dihydroxymethylvalerate to α-ketomethylvalerate. In some embodiments of the method to convert 2,3-dihydroxyisovalerate to α-ketoisovalerate or 2,3-dihydroxymethylvalerate to α-ketomethylvalerate, the isolated polypeptide or fragment thereof is comprised within a recombinant host cell.

In some embodiments of the method to convert 2,3-dihydroxyisovalerate to α-ketoisovalerate or 2,3-dihydroxymethylvalerate to α-ketomethylvalerate, the recombinant host cell is cultured in a fermentation medium under suitable conditions to produce isobutanol or 2-methylbutanol, respectively, from pyruvate, and the isobutanol or 2-methylbutanol is recovered. In some embodiments, the isobutanol or 2-methylbutanol is recovered by distillation, liquid-liquid extraction, adsorption, decantation, pervaporation, or combinations thereof. In some embodiments, solids are removed from the fermentation medium. In some embodiments, solids are removed from the fermentation medium by centrifugation, filtration, decantation, or combinations thereof. In other embodiments, the solids are removed before the isobutanol is recovered. In other embodiments, the conversion of 2,3-dihydroxyisovalerate to α-ketoisovalerate or 2,3-dihydroxymethylvalerate to α-ketomethylvalerate is improved as compared to a control conversion under the same conditions with a control polypeptide having DHAD activity which does not comprise an amino acid substitution.

Another aspect of the invention is directed to a composition comprising one or more recombinant host cells of the invention, and a fermentable carbon substrate.

Another aspect of the invention is directed to a composition comprising one or more recombinant host cells of the invention, and isobutanol. In other embodiments, the composition further comprises an extractant.

The present invention is also directed to, for example, polypeptides having DHAD activity that have been altered to improve DHAD activity, for example, by the addition of a peptide tag at the C-terminal region of the DHAD. In some embodiments, the present invention is directed to a recombinant polypeptide having DHAD activity, or variant thereof, wherein the polypeptide or variant thereof comprises a C-terminal tag comprising the polypeptide sequence of CCPGCCG (SEQ ID NO:723), MCPGCCG (SEQ ID NO:724), CMPGCCG (SEQ ID NO:725), CCPGMCG (SEQ ID NO:726), CCPGCMG (SEQ ID NO:727), MCPGMCG (SEQ ID NO:728), MMPGCCG (SEQ ID NO:729), CMPGMCG (SEQ ID NO:730), CMPGCMG (SEQ ID NO:731), CCPGMMG (SEQ ID NO:732), MCPGCMG (SEQ ID NO:733), MMPGMCG (SEQ ID NO:734), CMPGMMG (SEQ ID NO:735), MCPGMMG (SEQ ID NO:736), MMPGCMG (SEQ ID NO:737), MMPGMMG (SEQ ID NO:738), CSCPGCCG (SEQ ID NO:739), CPCPGCCG (SEQ ID NO:740), CECPGCCG (SEQ ID NO:741), CCPGCSCG (SEQ ID NO:742), CCPGCPCG (SEQ ID NO:743), CCPGCECG (SEQ ID NO:744), CCPEGCCG (SEQ ID NO:745), CCPAGCCG (SEQ ID NO:746), SEQ ID NO:747, SEQ ID NO:748, or a variant thereof. In embodiments, the recombinant polypeptide having DHAD activity comprises any one of SEQ ID NOs:749-772, or a variant thereof. In embodiments, the present invention is directed to a DHAD polypeptide or variant thereof having at least about 85%, at least about 90%, or at least about 95% identity to any one of SEQ ID NOs:773-784. In embodiments, the present invention is directed to a DHAD polypeptide or variant thereof having at least about 85%, at least about 90%, or at least about 95% identity to any one of SEQ ID NOs:773-784, which further comprises a C-terminal tag comprising the polypeptide sequence of any one of SEQ ID NOs:723-772, or a variant thereof.

The present invention is also directed to a recombinant nucleic acid molecule which encodes a polypeptide or variant thereof of the present invention.

The present invention is also directed to a recombinant host cell comprising a polypeptide or variant thereof of the present invention, or a recombinant nucleic acid molecule which encodes a polypeptide or variant thereof of the present invention.

The present invention is also directed to various methods of use of the polypeptides or variants thereof of the present invention. In some embodiments, the present invention is directed to a method of converting 2,3-dihydroxyisovalerate to α-ketoisovalerate or 2,3-dihydroxymethylvalerate to α-ketomethylvalerate, comprising (a) providing a polypeptide having DHAD activity or variant thereof, wherein the polypeptide or variant thereof comprises a C-terminal polycysteine tag or variant thereof, or a polyhistidine tag or variant thereof, and (b) contacting the polypeptide or variant thereof with 2,3-dihydroxyisovalerate or 2,3-dihydroxymethylvalerate under conditions whereby 2,3-dihydroxyisovalerate is converted to α-ketoisovalerate, or whereby 2,3-dihydroxymethylvalerate is converted to α-ketomethylvalerate. In other embodiments, the present invention is directed to a method of producing isobutanol comprising (a) providing a recombinant host cell comprising a recombinant nucleic acid molecule which encodes a polypeptide or variant thereof of the present invention, and (b) contacting the host cell with a carbon substrate under conditions whereby isobutanol is produced; and (c) optionally, recovering the isobutanol.

The present invention is also directed to other isolated polypeptides and fragments thereof having dihydroxy-acid dehydratase (DHAD) activity and to isolated nucleic acids encoding such polypeptides and fragments thereof. In one aspect, the present invention is directed to an isolated polypeptide or fragment thereof having DHAD activity, wherein the polypeptide or fragment thereof comprises an amino acid sequence which is at least 90% identical to the amino acid sequence of SEQ ID NO:724. In another aspect, the present invention is directed to an isolated polypeptide or fragment thereof having DHAD activity, wherein the polypeptide or fragment thereof comprises the amino acid sequence of SEQ ID NO:773 having a deletion of 1 or more of the C-terminal amino acids of SEQ ID NO:773. In another aspect, the present invention is directed to an isolated nucleic acid molecule encoding a DHAD, wherein the DHAD comprises an amino acid sequence which is at least 90% identical to the amino acid sequence of SEQ ID NO:724. In another aspect, the present invention is directed to an isolated nucleic acid molecule encoding a DHAD, wherein the DHAD comprises the amino acid sequence of SEQ ID NO:773 having a deletion of 1 or more of the C-terminal amino acids of SEQ ID NO:773.

The present invention is also directed to a vector comprising an isolated nucleic acid molecule of the present invention.

The present invention is also directed to a recombinant host cell comprising an isolated nucleic acid molecule of the present invention or a vector of the present invention.

The present invention is also directed to a method for the production of isobutanol, comprising providing a recombinant host cell of the present invention, culturing the recombinant host cell in a fermentation medium under suitable conditions to produce isobutanol from pyruvate, and recovering the isobutanol.

The present invention is also directed to a method of converting 2,3-dihydroxyisovalerate to α-ketoisovalerate, comprising providing the isolated polypeptide or fragment thereof of the present invention, wherein the isolated polypeptide or fragment thereof catalyzes the conversion of 2,3-dihydroxyisovalerate to α-ketoisovalerate.

The present invention is also directed to a composition comprising a recombinant host cell of the invention and a fermentable carbon substrate.

The present invention is also directed to a composition comprising a recombinant host cell of the invention and isobutanol.

BRIEF DESCRIPTION OF THE DRAWINGS

The accompanying drawings, which are incorporated herein and form a part of the specification, illustrate the present invention and, together with the description, further serve to explain the principles of the invention and to enable a person skilled in the pertinent art to make and use the invention.

FIG. 2 is a schematic diagram showing an 11 amino acid motif spanning positions 378 to 388 of *Streptococcus mutans* (*S. mutans*) DHAD (SEQ ID NO:547).

Figure 1:
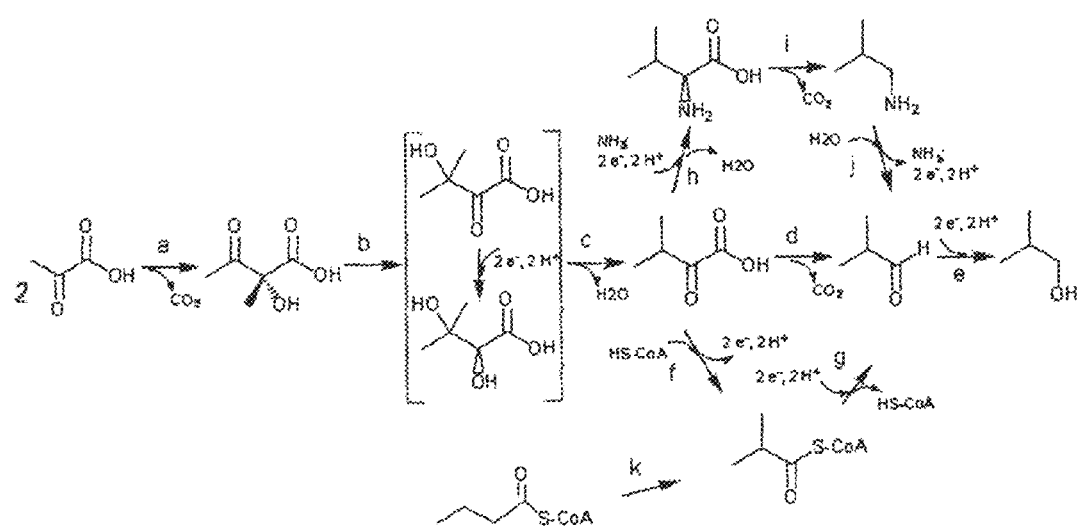
FIG. 1 shows biosynthetic pathways for isobutanol production.

Table 6 is a table of the Profile HMM for dihydroxy-acid dehydratases based on enzymes with assayed function prepared as described in the Examples. Table 6 is submitted herewith electronically and is incorporated herein by reference.

DETAILED DESCRIPTION OF THE INVENTION

For improved production of compounds synthesized in pathways including dihydroxy-acid dehydratase (DHAD), it is desirable to express a heterologous DHAD enzyme that provides this enzymatic activity in the production host of interest. However, there exists a need for alternative DHAD enzymes and DHAD variants that display modified activity as compared to a parental DHAD enzyme in heterologous organisms. Such enzymes may be employed for production of compounds from DHAD-requiring biosynthetic pathways.

The present invention satisfies these and other needs, and provides further related advantages, as will be made apparent by the description of the embodiments that follow.

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

DEFINITIONS

In order to further define this invention, the following terms and definitions are herein provided.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition.

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The terms "invention" or "present invention" as used herein are non-limiting terms and are not intended to refer to any single embodiment of the particular invention but encompass all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value; in another embodiment, within 5% of the reported numerical value.

The term "alcohol" as used herein refers to any of a series of hydroxyl compounds, the simplest of which are derived from saturated hydrocarbons, having the general formula $C_nCH_{2n}+1OH$. Examples of alcohol include ethanol and butanol.

The term "butanol" as used herein refers to n-butanol, 2-butanol, isobutanol, tert-butyl alcohol, individually or any mixtures thereof, Butanol can be from a biological source (i.e., biobutanol), for example.

The term "[2Fe-2S]$^{2+}$ DHAD" refers to DHAD enzymes having a bound [2Fe-2S]$^{2+}$ iron-sulfur cluster.

The term "[4Fe-4S]$^{2+}$ DHAD" refers to DHAD enzymes having a bound [4Fe-4S]$^{2+}$ iron-sulfur cluster.

The terms "acetohydroxy acid dehydratase" and "dihydroxy-acid dehydratase" ("DHAD") refer to an enzyme that catalyzes the conversion of 2,3-dihydroxyisovalerate to α-ketoisovalerate. Example acetohydroxy acid dehydratases are known by the EC number 4.2.1.9. Such enzymes are available from a vast array of microorganisms, including, but not limited to, *Escherichia coli* (GentBank Nos: YP_026248, NC_000913), *Saccharomyces cerevisiae* (GenBank Nos: NP_012550, NC 001142), *Methanococcus maripaludis* (GenBank Nos: CAF29874, BX957219), *Bacillus subtilis* (GenBank Nos: CAB14105, Z99115), *Lactobacillus lactis*, and *Neurospora crassa*. U.S. Appl. Pub. No. 2010/0081154 and U.S. Pat. No. 7,851,188, which are incorporated herein by reference, describe dihydroxy-acid dehydratases (DHADs), including a DHAD from *Streptococcus mutans* (Nucleic Acid: SEQ ID NO:543; Amino Acid: SEQ ID NO:544).

The term "isobutanol biosynthetic pathway" as used herein refers to an enzyme pathway to produce isobutanol from pyruvate.

The terms "acetohydroxyacid synthase," "acetolactate synthase" and "acetolactate synthetase" (abbreviated "ALS") are used interchangeably herein to refer to an enzyme that catalyzes the conversion of pyruvate to acetolactate and $CO_2$. Example acetolactate synthases are known by the EC number 2.2.1.6 (Enzyme Nomenclature 1992, Academic Press, San Diego). These enzymes are available from a number of sources, including, but not limited to, *Bacillus subtilis* (GenBank Nos. CAB07802.1, CAB15618 and Z99122, NCBI (National Center for Biotechnology Information) amino acid sequence, NCBI nucleotide sequence, respectively), *Klebsiella pneumoniae* (GenBank Nos. AAA25079 and M73842), and *Lactococcus lactis* (GenBank Nos. AAA25161 and L16975).

The terms "ketol-acid reductoisomerase" ("KARI"), "acetohydroxy acid reductoisomerase," and "acetohydroxy acid isomeroreductase" are used interchangeably herein to refer an enzyme that catalyzes the reaction of (S)-acetolactate to 2,3-dihydroxyisovalerate. Example KARI enzymes are classified as EC number 1.1.1.86 (Enzyme Nomenclature 1992, Academic Press, San Diego), and are available from a vast array of microorganisms, including, but not limited to, *Escherichia coli* (GenBank Nos. NP_418222 and NC_000913), *Saccharomyces cerevisiae* (GenBank Nos. NP 013459 and NC_001144), *Methanococcus maripaludis* (GenBank Nos. CAF30210 and BX957220), and *Bacillus subtilis* (GenBank Nos. CAB14789 and Z99118). KARIs include, for example, *Anaerostipes caccae* KARI variants "K9G9", "K9D3", and "K9JB4P" (e.g., SEQ ID NO:697). KARI enzymes are also described in U.S. Pat. Nos. 7,910, 342 and 8,129,162, U.S. Appl. Pub. No. 2010/0197519, and PCT Appl. Pub. Nos. WO2011/041415, WO2012/129555, and WO2013/176909A2, which are incorporated herein by reference. Examples of KARIs disclosed therein include those from *Lactococcus lactis, Vibrio cholera, Pseudomonas aeruginosa* PAO1, *Pseudomonas fluorescens* PF5, and *Anaerostipes caccae*. In some embodiments, KARI utilizes NADH (reduced nicotinamide adenine dinucleotide). In some embodiments, KARI utilizes NADPH (reduced nicotinamide adenine dinucleotide phosphate).

The terms "branched-chain α-keto acid decarboxylase," "α-ketoacid decarboxylase," "α-ketoisovalerate decarboxylase," and "2-ketoisovalerate decarboxylase" ("KIVD") are used interchangeably herein to refer to an enzyme that catalyzes the conversion of α-ketoisovalerate to isobutyraldehyde and $CO_2$. Example branched-chain α-keto acid decarboxylases are known by the EC number 4.1.1.72 and are available from a number of sources, including, but not limited to, *Lactococcus lactis* (GenBank Nos. AAS49166, AY548760, CAG34226, and AJ746364, *Salmonella typhimurium* (GenBank Nos. NP_461346 and NC_003197), *Clostridium acetobutylicum* (GenBank Nos. NP_149189 and NC_001988), *Macrococcus caseolyticus*, and *Listeria grayi*. Example KIVD enzymes are disclosed in U.S. Appl. Pub. US 2013/0203138, incorporated by reference.

The terms "branched-chain alcohol dehydrogenase" and "alcohol dehydrogenase" ("ADH") are used interchangeably herein to refer to an enzyme that catalyzes the conversion of isobutyraldehyde to isobutanol. Example branched-chain alcohol dehydrogenases are known by the EC number 1.1.1.265, but can also be classified under other alcohol dehydrogenases (specifically, EC numbers 1.1.1.1 or 1.1.1.2). Alcohol dehydrogenases can be, for example, NADPH dependent or NADH dependent. Such enzymes are available from a number of sources, including, but not limited to, *Saccharomyces cerevisiae* (GenBank Nos. NP_010656, NC_001136, NP_014051, and NC_001145), *Escherichia coli* (GenBank Nos. NP_417484 and NC_000913), and *Clostridium acetobutylicum* (GenBank Nos. NP_349892, NC_003030, NP_349891, and NC_0030300). U.S. Pat. No. 8,188,250 (incorporated herein by reference) describes SadB, an alcohol dehydrogenase (ADH) from *Achromobacter xytosoxidans*. Alcohol dehydrogenases also include horse liver ADH and *Beijerinkia indica* ADH (as described in U.S. Appl. Publ. No. 2011/0269199, which is incorporated herein by reference).

The terms "carbon substrate" and "fermentable carbon substrate" are used interchangeably herein to refer to a carbon source capable of being metabolized by host organisms of the present invention and particularly carbon sources selected from the group consisting of monosaccharides, oligosaccharides, polysaccharides, and one-carbon substrates or mixtures thereof. Carbon substrates can include six carbon (C6) and five carbon (C5) sugars and mixtures thereof such as, for example, glucose, sucrose or xylose.

The term "polynucleotide" as used herein encompasses a singular nucleic acid as well as plural nucleic acids, and refers to a nucleic acid molecule or construct, e.g., messenger RNA (mRNA) or plasmid DNA (pDNA). A polynucleotide can contain the nucleotide sequence of the full-length cDNA sequence, or a fragment thereof including the untranslated 5' and 3' sequences and the coding sequences. The polynucleotide can be composed of any polyribonucleotide or polydeoxyribonucleotide, which can be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. "Polynucleotide" embraces chemically, enzymatically, or metabolically modified forms.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene can comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

As used herein, the term "coding region" refers to a DNA sequence that codes for a specific amino acid sequence. "Suitable regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, translation leader sequences, introns, polyadenylation recognition sequences, RNA processing site, effector binding site and stem-loop structure.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, enhancers, operators, repressors, transcription termination signals, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters can be derived in their entirety from a native gene, or composed of different elements derived from different promoters found in nature, or even comprise synthetic DNA segments. It is understood by those skilled in the art that different promoters can direct the expression of a gene in different tissues or cell types, or at different stages of development, or in response to different environmental or physiological conditions. Promoters which cause a gene to be expressed in most cell types at most times are commonly referred to as "constitutive promoters." It is further recognized that since in most cases the exact boundaries of regulatory sequences have not been completely defined, DNA fragments of different lengths can have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression can also refer to translation of mRNA into a polypeptide.

The term "over-expression", as used herein, refers to expression that is higher than endogenous expression of the same or related polynucleotide or gene. A heterologous polynucleotide or gene is also over-expressed if its expression is higher than that of a comparable endogenous gene, or if its expression is higher than that of the same polynucleotide or gene introduced by a means that does not overexpress the polynucleotide or gene. For example, a polynucleotide can be expressed in a host cell from a low copy number plasmid, which is present in only limited or few copies, and the same polynucleotide can be over-expressed in a host cell from a high copy number plasmid or a plasmid with a copy number that can be regulated, which is present in multiple copies. Any means can be used to over-express a polynucleotide, so long as it increases the copies of the polynucleotide in the host cell. In addition to using a high copy number plasmid, or a plasmid with a copy number that can be regulated, a polynucleotide can be over-expressed by multiple chromosomal integrations. Expression or over-expression of a polypeptide of the invention in a recombinant host cell can be quantified according to any number of methods known to the skilled artisan and can be represented, e.g., by a percent of total cell protein. The percent of total protein can be an amount selected from greater than about 0.001% of total cell protein; greater than about 0.01% of total cell protein; greater than about 0.1% of total cell protein; greater than about 0.5% of total cell protein; greater than about 1.0% of total cell protein; greater than about 2.0% of total cell protein; greater than about 3.0% of total cell protein; greater than about 4.0% of total cell protein; greater than about 5.0% of total cell protein; greater than about 6.0% of total cell protein; greater than about 7.0% of total cell protein; greater than about 8.0% of total cell protein; greater than about 9.0% of total cell protein; greater than about 10% of total cell protein; or greater than about 20% of total cell protein. In one embodiment, the amount of polypeptide expressed is greater that about 0.5% of total cell protein. In another embodiment, the amount of polypeptide expressed is greater than about 1.0% of total cell protein or greater than about 2.0% of total cell protein.

As used herein, the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements can be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

A "recombinant host cell" is defined as a host cell that has been genetically manipulated to express a biosynthetic production pathway, wherein the host cell either produces a biosynthetic product in greater quantities relative to an unmodified host cell or produces a biosynthetic product that is not ordinarily produced by an unmodified host cell.

The term "engineered" as applied to a isobutanol biosynthetic pathway refers to the isobutanol biosynthetic pathway that is manipulated, such that the carbon flux from pyruvate through the engineered isobutanol biosynthetic pathway is maximized, thereby producing an increased amount of isobutanol directly from the fermentable carbon substrate. Such engineering includes expression of heterologous polynucleotides or polypeptides, overexpression of endogenous polynucleotides or polypeptides, cytosolic localization of proteins that do not naturally localize to cytosol, increased cofactor availability, decreased activity of competitive pathways, etc.

The term "codon optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

|   | T | C | A | G |
|---|---|---|---|---|
| T | TTT Phe (F) | TCT Ser (S) | TAT Tyr (Y) | TGT Cys (C) |
|   | TTC Phe (F) | TCC Ser (S) | TAC Tyr (Y) | TGC |
|   | TTA Leu (L) | TCA Ser (S) | TAA Stop | TGA Stop |
|   | TTG Leu (L) | TCG Ser (S) | TAG Stop | TGG Trp (W) |
| C | CTT Leu (L) | CCT Pro (P) | CAT His (H) | CGT Arg (R) |
|   | CTC Leu (L) | CCC Pro (P) | CAC His (H) | CGC Arg (R) |
|   | CTA Leu (L) | CCA Pro (P) | CAA Gln (Q) | CGA Arg (R) |
|   | CTG Leu (L) | CCG Pro (P) | CAG Gln (Q) | CGG Arg (R) |
| A | ATT Ile (I) | ACT Thr (T) | AAT Asn (N) | AGT Ser (S) |
|   | ATC Ile (I) | ACC Thr (T) | AAC Asn (N) | AGC Ser (S) |
|   | ATA Ile (I) | ACA Thr (T) | AAA Lys (K) | AGA Arg (R) |
|   | ATG Met(M) | ACG Thr (T) | AAG Lys (K) | AGG Arg (R) |
| G | GTT Val (V) | GCT Ala (A) | GAT Asp (D) | GGT Gly (G) |
|   | GTC Val (V) | GCC Ala (A) | GAC Asp (D) | GGC Gly (G) |
|   | GTA Val (V) | GCA Ala (A) | GAA Glu (E) | GGA Gly (G) |
|   | GTG Val (V) | GCG Ala (A) | GAG Glu (E) | GGG Gly (G) |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

As used herein, an "isolated nucleic acid fragment" or "isolated nucleic acid molecule" are used interchangeably herein and mean a polymer of RNA or DNA that is single- or double-stranded, optionally containing synthetic, non-natural or altered nucleotide bases. Accordingly, an "isolated" nucleic acid fragment or molecule can be, for example, "recombinant" or "engineered." An isolated nucleic acid fragment in the form of a polymer of DNA can be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified, for example, in Sambrook, J., Fritsch, E. F. and Maniatis, T. Molecular Cloning: A Laboratory Manual, 2nd ed., Cold Spring Harbor Laboratory: Cold Spring Harbor, N.Y. (1989), particularly Chapter 11 and Table 11.1 therein (incorporated herein by reference in its entirety). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1× SSC, 0.1% SDS at 65° C. An additional set of stringent conditions include hybridization at 0.1×SSC, 0.1% SDS, 65° C. and washes with 2×SSC, 0.1% SDS followed by 0.1× SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment, the length for a hybridizable nucleic acid is at least about 10 nucleotides. Preferably, a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration can be adjusted as necessary according to factors such as length of the probe.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" can be used instead of, or interchangeably with any of these terms. A polypeptide can be derived from a natural biological source or produced by recombinant technology, but is not necessarily translated from a designated nucleic acid sequence. It can be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposes of the invention, as are native or recombinant polypeptides which have been separated, fractionated, or partially or substantially purified by any suitable technique.

As used herein, the term "variant" refers to a polypeptide differing from a specifically recited polypeptide of the invention, such as DHAD, by amino acid insertions, deletions, mutations, and substitutions, created using, e.g., recombinant DNA techniques, such as mutagenesis. Guidance in determining which amino acid residues can be replaced, added, or deleted without abolishing activities of interest, can be found by comparing the sequence of the particular polypeptide with that of homologous polypeptides, e.g., yeast or bacterial, and minimizing the number of amino acid sequence changes made in regions of high homology (conserved regions) or by replacing amino acids with consensus sequences.

Alternatively, recombinant polynucleotide variants encoding these same or similar polypeptides can be synthesized or selected by making use of the "redundancy" in the genetic code. Various codon substitutions, such as silent changes which produce various restriction sites, can be introduced to optimize cloning into a plasmid or viral vector for expression. Mutations in the polynucleotide sequence can be reflected in the polypeptide or domains of other peptides added to the polypeptide to modify the properties of any part of the polypeptide.

Amino acid "substitutions" can be the result of replacing one amino acid with another amino acid having similar structural and/or chemical properties, i.e., conservative amino acid replacements, or they can be the result of replacing one amino acid with an amino acid having different structural and/or chemical properties, i.e., non-conservative amino acid replacements. "Conservative" amino acid substitutions can be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" can be within the range of variation as structurally or functionally tolerated by the recombinant proteins. The variation allowed can be experimentally determined by systematically making insertions, deletions, or substitutions of amino acids in a polypeptide molecule using recombinant DNA techniques and assaying the resulting recombinant variants for activity.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., J. Mol. Biol., 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides can be used in sequence-dependent methods of gene identification (e.g., Southern hybridization) and isolation (e.g., in situ hybridization of bacterial colonies or bacteriophage plaques). In addition, short oligonucleotides of 12-15 bases can be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, can now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" or "sequence identity" also means the degree of sequence relatedness between polypeptide or polynucleotide sequences, as the case may be, as determined by the match between strings of such sequences. "Identity" and "similarity" can be readily calculated by known methods, including but not limited to those described in: (1. Computational Molecular Biology (Lesk, A. M., Ed.) Oxford University: NY (1988); (2) Biocomputing: Informatics and Genome Projects (Smith, D. W., Ed.) Academic: NY (1993); (3) Computer Analysis of Sequence Data, Part I (Griffin, A. M., and Griffin, H. G., Eds.) Humania: NJ (1994); (4) Sequence Analysis in Molecular Biology (von Heinje, G., Ed.) Academic (1987); and (5) Sequence Analysis Primer (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations can be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, CABIOS. 5:151-153 (1989); Higgins, D. G. et al., Comput. Appl. Biosci., 8:189-191 (1992)) and found in the MegAlign™ program of the LASERGENE bioinformatics computing suite (DNAS- TAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally, the "Clustal W method of alignment" is available and corresponds to the alignment method labeled Clustal W (described by Higgins and Sharp, CABIOS. 5:151-153 (1989); Higgins, D. G. et al., Comput. Appl. Biosci. 8:189-191 (1992); Thompson, J. D., Higgins, D. G., and Gibson T. J. (1994) Nuc. Acid Res. 22: 4673-4680) and found in the MegAlign™ v6.1 program of the LASERGENE bioinformatics computing suite (DNASTAR Inc.). Default parameters for multiple alignment are GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB. After alignment of the sequences using the Clustal W program, it is possible to obtain a "percent identity" by viewing the "sequence distances" table in the same program.

it is well understood by one skilled in the art that many levels of sequence identity are useful in identifying polypeptides, from other species, wherein such polypeptides have the same or similar function or activity. Useful examples of percent identities include, but are not limited to: 55%, 60%, 65%, 70%, 75%, 80%, 85%, 90%, or 95%, or any integer percentage from 55% to 100% is useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" can be commercially available or independently developed. Typical sequence analysis software will include, but is not limited to: (1) the GCG suite of programs (Wisconsin Package Version 9.0, Genetics Computer Group (GCG), Madison, Wis.); (2) BLASTP, BLASTN, BLASTX (Altschul et al., J. Mol. Biol., 215:403-410 (1990)); (3) DNASTAR (DNASTAR, Inc. Madison, Wis.); (4) Sequencher (Gene Codes Corporation, Ann Arbor, Mich.); and (5) the FASTA program incorporating the Smith-Waterman algorithm (W. R. Pearson, Comput. Methods Genome Res., [Proc. Int. Symp.](1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein, "default values" means any set of values or parameters that originally load with the software when first initialized.

"Fermentation medium" as used herein means a mixture of water, fermentable carbon substrates, dissolved solids, fermentation product and all other constituents of the material held in the fermentation vessel in which the fermentation product is being made by the reaction of fermentable carbon substrates to fermentation products, water and carbon dioxide ($CO_2$) by the microorganisms present. From time to time, as used herein, the terms "fermentation broth" and "fermentation mixture" can be used synonymously with "fermentation medium."

As used herein, the term "yield" refers to the amount of product in grams per amount of carbon source in grams (g/g). The yield can be exemplified, for example, for glucose as the carbon source. It is understood, unless otherwise noted, that yield is expressed as a percentage of the theoretical yield. In reference to a microorganism or metabolic pathway, "theoretical yield" is defined as the maximum amount of product that can be generated per total amount of substrate as dictated by the stoichiometry of the metabolic pathway used to make the product. For example, the theoretical yield for one typical conversion of glucose to isopropanol is 0.33 g/g. As such, a yield of isopropanol from glucose of 0.297 g/g would be expressed as 90% of theoretical or 90% theoretical yield. It is understood that, while in the present disclosure the yield is exemplified for glucose as a carbon source, the invention can be applied to other carbon sources and the yield can vary depending on the carbon source used. One skilled in the art can calculate yields on various carbon sources.

The term "titer" as used herein, refers to the total amount of butanol isomer produced by fermentation per liter of fermentation medium. The total amount of butanol isomer includes: (i) the amount of butanol in the fermentation medium; (ii) the amount of butanol isomer recovered from the organic extractant; and (iii) the amount of butanol isomer recovered from the gas phase, if gas stripping is used.

Standard recombinant DNA and molecular cloning techniques used herein are well known in the art and are described by Sambrook, J., Fritsch, E. F. and Maniatis, T., Molecular Cloning: A Laboratory Manual, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., Experiments with Gene Fusions, Cold Spring Harbor Laboratory Press, Cold Spring Harbor, N.Y. (1984); and by Ausubel, F. M. et al., Current Protocols in Molecular Biology, published by Greene Publishing Assoc. and Wiley-Interscience (1987). Additional methods used herein are in Methods in Enzymology, Volume 194, Guide to Yeast Genetics and Molecular and Cell Biology (Part A, 2004, Christine Guthrie and Gerald R. Fink (Eds.), Elsevier Academic Press, San Diego, Calif.).

DHAD Variants

As described above, dihydroxy-acid dehydratase (DHAD), also called acetohydroxy acid dehydratase, catalyzes the conversion of 2,3-dihydroxyisovalerate to α-ketoisovalerate and of 2,3-dihydroxymethylvalerate to α-ketomethylvalerate. The DHAD enzyme is part of naturally occurring biosynthetic pathways producing valine, isoleucine, leucine and pantothenic acid (vitamin B5). DHAD catalyzed conversion of 2,3-dihydroxyisovalerate to α-ketoisovalerate is also a step in the multiple isobutanol biosynthetic pathways that are disclosed in U.S. Pat. No. 7,851,188 and (both incorporated herein by reference). For production of compounds synthesized in pathways including DHAD, it is desirable to express a heterologous DHAD enzyme that provides DHAD enzymatic activity in a host cell. A consideration for functional expression of dihydroxyacid dehydratases in a heterologous host is the enzyme's requirement for an iron-sulfur (Fe—S) cluster, which involves availability and proper loading of the cluster into the DHAD apo-protein.

The present invention is based on the discovery that certain variants of DHAD have DHAD activity, and, in some embodiments, improved activity compared to the parental DHAD molecule. DHAD variants are desirable for production of products produced by DHAD containing biosynthetic pathways, particularly isobutanol.

It has been discovered that alterations in the amino acid sequence of an 11-amino acid motif found in DHAD enzymes can lead to improved DHAD activity as indicated by increased isobutanol production. For the purposes of the present invention, amino acid substitutions were made in the *Streptococcus mutans* DHAD enzyme (SEQ ID NO:544), however, equivalent substitutions can be made in the homologous regions of DHAD enzymes from other organisms. A list of example DHAD enzymes that may be used to produce the DHAD variants of the invention is included below in Tables 3-5. Other sources of DHADs include, for example, *Streptococcus downei, Oscillatoria* species PCC 6506, *Zea mays, Lactococcus lactis, Neurospora crassa*, and *Streptococcus macacae*.

An 11-amino acid motif sequence which may be found in DHAD enzymes is: P-K-X-X-X-G-X-I/L-X-I-L, wherein X represents any amino acid (SEQ ID NO:875). This motif encompasses amino acid positions 378 through 388 of the *Streptococcus mutans* DHAD enzyme. Throughout this description, the positions of the amino acids in the 11-amino acid motif are numbered 1 through 11, with amino acid residue 1 representing the first proline and amino acid residue 11 representing the last leucine. In addition, amino acids are described herein using either the full name of the amino acid or the 1-letter or 3-letter abbreviation of the amino acid, as indicated in Table 2.

TABLE 2

Amino Acids and their Abbreviations

| Amino Acid | 1-Letter Symbol | 3-Letter Symbol |
| --- | --- | --- |
| Alanine | A | Ala |
| Arginine | R | Arg |
| Asparagine | N | Asn |
| Aspartic acid | D | Asp |
| Cystesne | C | Cys |
| Glutamine | Q | Gln |
| Glutamic acid | E | Glu |
| Pyroglutamic acid | pQ | pGlu |
| Glycine | G | Gly |
| Histidine | H | His |
| Hydroxylysine | | Hyl |
| Hydroxyproline, 4(R)-L- | O | Hyp |
| Isoleucine | I | Ile |
| Leucine | L | Leu |
| Lysine | K | Lys |
| Methionine | M | Met |
| Phenylalanine | F | Phe |
| Proline | P | Pro |
| Serine | S | Ser |
| Threonine | T | Thr |
| Tryptophan | W | Trp |
| Tyrosine | Y | Tyr |
| Valine | V | Val |

The amino acid changes that were made and/or contemplated by the present invention to produce alternative, active DHAD enzymes are described herein, for example, by a three character code that begins with the 1-letter abbreviation of the native amino acid, followed by the amino acid position number, and followed by the 1-letter abbreviation of the identity of the substituted amino acid. For example, "P1A" refers to a proline to alanine substitution of the first position of the DHAD motif described, e.g., in SEQ ID NO:547. As explained above, the substitution in the first position represented by P1A (numbering according to the DHAD motif of SEQ ID NO:547) corresponds to position 378 of the *Streptococcus mutans* DHAD enzyme. Accordingly, P1A corresponds to P378A when the substitution is expressed in terms of the corresponding position of *Streptococcus mutans* DHAD. In some embodiments, the amino acid changes that were made and/or contemplated to produce alternative, active DHAD enzymes include, for example, P1A, P1G, P1V, P1I, P1L, K2I, K2L, G6S, G6A, G6V, G6L, G6I, L8F, L8V, L8G, L8A, L8V, I10V, I10M, I10L, I10G, I10A, L11I, L11M, L11V, L11A, and L11G, corresponding to the DHAD motif described, e.g., in SEQ ID NO:547. When expressed in terms of the corresponding positions of *Streptococcus mutans* DHAD, these substitutions are P378A, P378G, P378V, P378I, P378L, K379I, K379L, G383S, G383A, G383V, G383L, G383I, L385F, L385V, L385G, L385A, L385V, I387V, I387M, I387L, I387G, I387A, L388I, L388M, L388V, L388A, and L388G. Accordingly, examples of DHAD variants of the invention include, for example, a DHAD having a substitution of one or more of P378A, P378G, P378V, P378I, P378L, K379I, K379L, G383S, G383A, G383V, G383L, G383I, L385F, L385V, L385G, L385A, L385V, I387V, I387M, I387L, I387G, I387A, L388I, L388M, L388V, L388A, and L388G. As described in the Examples, clones containing a P378A substitution are referenced as P2A1 (for example, delta9-P2A1 and 689-P2A1). Clones containing a G383S substitution are referenced as G2S2 (for example, delta9-G2S2 and 689-G2S2). Clones containing a L385F substitution are referenced as L2F3 (for example, delta9-L2F3 and 689-L2F3). Clones containing a L385V substitution are referenced as L2V4 (for example, delta9-L2V4, 804-L2V4 and 689-L2V4). Clones containing a I387V substitution are referenced as I2V5 (for example, delta9-I2V5, 804-I2V5 and 689-I2V5). Clones containing a I387M substitution are referenced as I2M6 (for example, delta9-I2M6 and 689-I2M6). Clones containing a L388I substitution are referenced as L217 (for example, delta9-L217 and 689-L217). Clones containing a L388M substitution are referenced as L2M8 (for example, delta9-L2M8 and 689-L2M8). However, one or more of such substitutions can be made in the corresponding residue(s) of other DHAD enzymes.

Examples of alternative, active DHAD enzymes are described herein and include, for example, *Streptococcus mutans* P2A1 (Nucleic Acid: SEQ ID NO:549; Amino Acid: SEQ ID NO:550), *Streptococcus mutans* P2A1 delta9 (Δ9) (Nucleic Acid: SEQ ID NO:551; Amino Acid: SEQ ID NO:552), *Streptococcus mutans* G2S2 (Nucleic Acid: SEQ ID NO:554; Amino Acid: SEQ ID NO:555) *Streptococcus mutans* G2S2 delta9 (Δ9) (Nucleic Acid: SEQ ID NO:556; Amino Acid: SEQ ID NO:557), *Streptococcus mutans* L2F3 (Nucleic Acid: SEQ ID NO:559; Amino Acid: SEQ ID NO:560), *Streptococcus mutans* L2F3 (Δ9) (Nucleic Acid: SEQ ID NO:561; Amino Acid: SEQ ID) NO:562), *Streptococcus mutans* L2V4 (Nucleic Acid: SEQ ID NO:564; Amino Acid: SEQ ID NO:565), *Streptococcus mutans* L2V4 delta9 (Δ9) (Nucleic Acid: SEQ ID NO:566; Amino Acid: SEQ ID NO:567), *Streptococcus mutans* I2V5 (Nucleic Acid: SEQ ID NO:569; Amino Acid: SEQ ID NO:570), *Streptococcus mutans* I2V5 delta9 (Δ9) (Nucleic Acid: SEQ ID NO:571; Amino Acid: SEQ ID NO:572), *Streptococcus mutans* I2M6 (Nucleic Acid: SEQ ID NO:574; Amino Acid:

SEQ ID NO:575), *Streptococcus mutans* I2M6 delta9 (Δ9) (Nucleic Acid: SEQ ID NO:576; Amino Acid: SEQ ID NO:577), *Streptococcus mutans* L217 (Nucleic Acid: SEQ ID NO:579; Amino Acid: SEQ ID NO:580), *Streptococcus mutans* L217 delta9 (Δ9) (Nucleic Acid: SEQ ID NO:581; Amino Acid: SEQ ID NO:582), *Streptococcus mutans* L2M8 (Nucleic Acid: SEQ ID NO:584; Amino Acid: SEQ ID NO:585), *Streptococcus mutans* L2M8 delta9 (Δ9) (Nucleic Acid: SEQ ID NO:586; Amino Acid: SEQ ID NO:587), *Streptococcus mutans* 689-P2A1 (Nucleic Acid: SEQ ID NO:860; Amino Acid: SEQ ID NO:861), *Streptococcus mutans* 689-G2S2 (Nucleic Acid: SEQ ID NO:862; Amino Acid: SEQ ID NO:863), *Streptococcus mutans* 689-L2F3 (Nucleic Acid: SEQ ID NO:864; Amino Acid: SEQ ID NO:865), *Streptococcus mutans* 689-L2V4 (Nucleic Acid: SEQ ID NO:866; Amino Acid: SEQ ID NO:867), *Streptococcus mutans* 689-I2V5 (Nucleic Acid: SEQ ID NO:786; Amino Acid: SEQ ID NO:787), *Streptococcus mutans* 689-2M6 (Nucleic Acid: SEQ ID NO:868; Amino Acid: SEQ ID NO:869), *Streptococcus mutans* 689-L217 (Nucleic Acid: SEQ ID NO:870; Amino Acid: SEQ ID NO:871), and *Streptococcus mutans* 689-L2M8 (Nucleic Acid: SEQ ID NO:872; Amino Acid: SEQ ID NO:873). Accordingly, in some embodiments, the invention is directed to an isolated polypeptide or fragment thereof having DHAD activity, wherein the polypeptide or fragment thereof comprises one or more amino acid substitutions selected from P1A, P1S, G6S, G6A, L8F, L8V, L8M, L8A, I10V, I10M, I10L, I10G, I10A, L11I, L11M, L11V, L11A, and L11F (numbering corresponding to the conserved 11-amino acid motif sequence found in DHAD enzymes of P-K-X-X-X-G-X-I/L-X-I-L, wherein X represents any amino acid amino acid), or one or more amino acid substitutions corresponding to amino acid positions P1A, P1S, G6S G6A, L8F, L8V, L8M, L8A, I10V, I10M, I10, I10G, I10A, L11I, L11M, L11V, L11A, and L11F of *S. mutans* DHAD.

In some embodiments, the invention provides an isolated polypeptide or fragment thereof having DHAD) activity, wherein the polypeptide or fragment thereof comprises an amino acid motif which is at least 90% identical to the amino acid sequence of SEQ ID NO:547, wherein the amino acid residue at position 2 of SEQ ID NO:547 is not isoleucine or leucine, and wherein the amino acid motif comprises one or more amino acid substitutions selected from: P1A, P1S, G6S, G6A, L8F, L8V, L8M, L8A, I10V, I10M, I10L, I10G, I10A, L11I, L11M, L11V, L11A, and L11F. In other embodiments, the polypeptide or fragment comprises an amino acid motif which is at least 60%, at least 65%, at least 70%, at least 75%, at least 80%, at least 85%, at least 90%, at least 95%, at least 96%, at least 97%, at least 98%, or at least 99% to the amino acid sequence of SEQ ID NO:547, wherein the amino acid residue at position 2 of SEQ ID NO:547 is not isoleucine or leucine, and wherein the amino acid motif comprises one or more amino acid substitutions selected from: P1A, P1S, G6S, G6A, L8F, L8V, L8M, L8A, I10V, I10M, I10L, I10G, I10A, L11I, L11M, L11V, L11A, and L11F. In some embodiments, the amino acid residue at position 2 of SEQ ID NO:547 is lysine. In some embodiments, the amino acid motif comprises at least an amino acid substitution at I10V. In other embodiments, the amino acid motif comprises at least an amino acid substitution at L8V.

The invention also provides an isolated polypeptide or fragment thereof having DHAD activity, wherein the polypeptide or fragment thereof comprises an amino acid motif which is at least 90% identical to the amino acid sequence of SEQ ID NO:548, wherein the amino acid motif comprises two or more amino acid substitutions selected from: P1A, P1S, G6S, G6A, L8F, L8V, L8M, L8A, I10V, I10M, I10L, I10G, I10A, L11I, L11M, L11V, L11A, and L11F. In other embodiments, the amino acid motif is at least 60%, at least 65%, at least 70%, at least 75%, at least 80%, at least 85%, at least 90%, at least 95%, at least 96%, at least 97%, at least 98%, or at least 99% identical to the amino acid sequence of SEQ ID NO:548, wherein the amino acid motif comprises two or more amino acid substitutions selected from: P1A, P1S, G6S, G6A, L8F, L8V, L8M, L8A, I10V, I10M, I10L, I10G, I10A, L11I, L11M, L11V, L11A, and L11F. In other embodiments, the amino acid motif comprises the amino acid sequence of SEQ ID NO:553, SEQ ID NO:558, SEQ ID NO:563, SEQ ID NO:568, SEQ ID NO:573, SEQ ID NO:578, SEQ ID NO:583, or SEQ ID NO:588. In other embodiments, the polypeptide or fragment thereof having DHAD activity comprises the amino acid sequence of SEQ ID NO:550, SEQ ID NO:555, SEQ ID NO:560, SEQ ID NO:565, SEQ ID NO:570, SEQ ID NO:575, SEQ ID NO:580, or SEQ ID NO:585. In other embodiments, the polypeptide or fragment thereof having DHAD activity comprises the amino acid sequence of SEQ ID NO:565. In other embodiments, the amino acid motif comprises the amino acid sequence of SEQ ID NO:573.

In embodiments, DHAD variant proteins display increased DHAD activity compared to DHAD proteins without the amino acid substitutions. In some embodiments, DHAD variant proteins expressed in yeast cytosol have a specific activity of greater than about 0.10 units/mg, greater than about 0.15 units/mg, greater than about 0.20 units/mg, greater than about 0.25 units/mg, greater than about 0.30 units/mg, greater than about 0.35 units/mg, or greater than about 0.40 units/mg.

Other alterations in the amino acid sequence of DHAD enzymes may lead to improved DHAD activity, as indicated, for example, by increased isobutanol production. These alterations include, for example, the addition of a peptide tag ("tag") to the C-terminal region of a DHAD. In some embodiments, the alteration is, for example, the addition of a sequence comprising a polyhistidine tag, a polycysteine tag, a V5 epitope, a myc epitope, a Lumio™ tag (Life Technologies; DNA: SEQ ID NO:785; Amino Acid: SEQ ID NO:747), or a tag such as SEQ ID NO: 748, for example, or a variant thereof, to the C-terminal end of a DHAD. In other embodiments, the alterations include, for example, the addition of a tag to the C-terminal region of a DHAD that comprises the polypeptide sequence of CCPGCCG (SEQ ID NO:723), MCPGCCG (SEQ ID NO:724), CMPGCCG (SEQ ID NO:725), CCPGMCG (SEQ ID NO:726), CCPGCMG (SEQ ID NO:727), MCPGMCG (SEQ ID NO:728), MMPGCCG (SEQ ID NO:729), CMPGMCG (SEQ ID NO:730), CMPGCMG (SEQ ID NO:731), CCPGMMG (SEQ ID NO:732), MCPGCMG (SEQ ID NO:733), MMPGMCG (SEQ ID NO:734), CMPGMMG (SEQ ID NO:735), MCPGMMG (SEQ ID NO:736), MMPGCMG (SEQ ID NO:737), MMPGMMG (SEQ ID NO:738), CSCPGCCG (SEQ ID NO:739), CPCPGCCG (SEQ ID NO:740), CECPGCCG (SEQ ID NO:741), CCPGCSCG (SEQ ID NO:742), CCPGCPCG (SEQ ID NO:743), CCPGCECG (SEQ ID NO:744), CCPEGCCG (SEQ ID NO:745), CCPAGCCG (SEQ ID NO:746), or variant thereof.

Disclosed herein are DHAD variants of a *Streptococcus mutans* DHAD enzyme (SEQ ID NO:773), however, equivalent alterations can be made in homokogous regions of DHAD enzymes from other organisms. Examples include SEQ ID NOs:749-772. A list of other DHAD enzymes that can be used to produce the DHAD variants of the invention is included below in Tables 3-5. Other sources of DHADs include, for example, *Streptococcus downei*, *Oscillatoria* species PCC 6506, *Zea mays*, *Lactococcus lactis*, *Neurospora crassa*, and *Streptococcus macacae*.

In some embodiments, DHAD variant proteins display increased DHAD activity compared to DHAD proteins without amino acid alterations. In some embodiments, DHAD variant proteins expressed in yeast cytosol have a specific activity of greater than 0.1 units/mg (U/mg), greater than 0.15 units/mg, greater than 0.2 units/mg, greater than 0.25 units/mg, greater than 0.3 units/mg, greater than 0.35 units/mg, greater than 0.4 units/mg, greater than 0.45 units/mg, greater than 0.5 units/mg, greater than 0.55 units/mg, greater than 0.6 units/mg, greater than 0.65 units/mg, greater than 0.7 units/mg, greater than 0.75 units/mg, greater than 0.8 units/mg, greater than 0.85 units/mg, greater than 0.9 units/mg, greater than 1 unit/mg, greater than 1.1 units/mg, greater than 1.2 units/mg, greater than 1.3 units/mg, greater than 1.4 units/mg, greater than 1.5 units/mg, greater than 1.6 units/mg, greater than 1.7 units/mg, greater than 1.8 units/mg, greater than 1.9 units/mg, greater than 2 units/mg, or any range of values thereof. In some embodiments, DHAD variant proteins expressed in yeast cytosol have a specific activity of about 0.1 units/mg, about 0.15 units/mg, about 0.2 units/mg, about 0.25 units/mg, about 0.3 units/mg, about 0.35 units/mg, about 0.4 units/mg, about 0.45 units/mg, about 0.5 units/mg, about 0.55 units/mg, about 0.6 units/mg, about 0.65 units/mg, about 0.7 units/mg, about 0.75 units/mg, about 0.8 units/mg, about 0.85 units/mg, about 0.9 units/mg, about 1 unit/mg, about 1.1 units/mg, about 1.2 units/mg, about 1.3 units/mg, about 1.4 units/mg, about 1.5 units/mg, about 1.6 units/mg, about 1.7 units/mg, about 1.8 units/mg, about 1.9 units/mg, about 2 units/mg, or more, or any range of values thereof. In some embodiments, the DHAD variant proteins have a specific activity of about 0.1 units/mg to about 2 units/mg, about 0.2 units/mg to about 2 units/mg, about 0.3 units/mg to about 2 units/mg, about 0.4 units/mg to about 2 units/mg, or about 0.5 units/mg to about 2 units/mg. In other embodiments, DHAD activity is increased in the DHAD variant by at least 10%, at least 20%, at least 30%, at least 40%, at least 50%, at least 60%, at least 70%, at least 80%, at least 90%, or at least 100% compared to DHAD proteins without an amino acid alteration, or any range of values thereof. In other embodiments, DHAD activity is increased in the DHAD variant by about 10%, about 20%, about 30%, about 40%, about 50%, about 60%, about 70%, about 80%, about 90%, about 100%, or more, compared to DHAD proteins without an amino acid alteration, or any range of values thereof. In some embodiments, DHAD activity is increased in the DHAD variant by about 10% to about 100%, about 20% to about 100%, about 30% to about 100%, about 40% to about 100%, about 50% to about 100%, about 60% to about 100%, about 10% to about 60%, about 20% to about 60%, about 30% to about 60%, about 40% to about 50%, or about 50% to about 60% compared to DHAD proteins without an amino acid alteration.

Other alterations in the amino acid sequence of DHAD enzymes can lead to improved DHAD activity, as indicated, for example, by increased isobutanol production. These alterations include, for example, a deletion of one or more of the C-terminal amino acids of DHAD. In some embodiments, the deletion is a deletion of at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, or at least 40 C-terminal amino acids of DHAD, or any range of values thereof. In some embodiments, the deletion is a deletion of about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, or more C-terminal amino acids of DHAD, or any range of values thereof. In other embodiments, the deletion is a deletion of about 1 to about 40 C-terminal amino acids of DHAD, including, but not limited to, about 1 to about 35, about 1 to about 30, about 1 to about 25, about 1 to about 20, about 1 to about 15, about 1 to about 10, about 5 to about 40, about 5 to about 35, about 5 to about 30, about 5 to about 25, about 5 to about 20, about 5 to about 15, or about 5 to about 10 C-terminal amino acids of DHAD. In some embodiments, the deletion is the 9 C-terminal amino acids of DHAD (DNA: SEQ ID NO:545; Protein: SEQ ID NO:546).

For the purposes of the present invention, amino acid deletions were made of the *Streptococcus mutans* DHAD enzyme (e.g., SEQ ID NO:544), however, equivalent deletions can be made in homologous regions of DHAD enzymes from other organisms. A list of other DHAD enzymes that may be used to produce the DHAD variants of the invention is included below in Tables 3-5.

In some embodiments, the invention is directed to an isolated polypeptide or fragment thereof having DHAD activity, wherein the polypeptide or fragment thereof comprises an amino acid sequence which is at least 90% identical to the amino acid sequence of SEQ ID NO:544. In other embodiments, the polypeptide or fragment comprises an amino acid sequence which is at least 60%, at least 65%, at least 70%, at least 75%, at least 80%, at least 85%, at least 90%, at least 95%, at least 96%, at least 97%, at least 98%, or at least 99% identical to the amino acid sequence of SEQ ID NO:528, or any range of values thereof. In other embodiments, the polypeptide or fragment comprises an amino acid sequence which is about 60%, about 65%, about 70%, about 75%, about 80%, about 85%, about 90%, about 95%, about 96%, about 97%, about 98%, or about 99% identical to the amino acid sequence of SEQ ID NO:544, or any range of values thereof. In other embodiments, the polypeptide or fragment comprises an amino acid sequence which is about 60% to about 99%, about 65% to about 99%, about 70% to about 99%, about 75% to about 99%, about 80% to about 99%, about 85% to about 99%, about 90% to about 99%, or about 95% to about 99% identical to the amino acid sequence of SEQ ID NO:544.

In some embodiments, DHAD variant proteins display increased DHAD activity compared to DHAD proteins without amino acid deletions. In some embodiments, DHAD variant proteins expressed in yeast cytosol have a specific activity of greater than 0.1 units/mg (U/mg), greater than 0.15 units/mg, greater than 0.2 units/mg, greater than 0.25 units/mg, greater than 0.3 units/mg, greater than 0.35 units/mg, greater than 0.4 units/mg, greater than 0.43 units/mg, greater than 0.45 units/mg, greater than 0.5 units/mg, greater than 0.55 units/mg, greater than 0.6 units/mg, greater than 0.65 units/mg, greater than 0.7 units/mg, greater than 0.75 units/mg, greater than 0.8 units/mg, or any range of values thereof. In some embodiments, DHAD variant proteins expressed in yeast cytosol have a specific activity of about 0.1 units/mg, about 0.15 units/mg, about 0.2 units/mg, about 0.25 units/mg, about 0.3 units/mg, about 0.35 units/mg, about 0.4 units/mg, about 0.43 units/mg, about 0.45 units/mg, about 0.5 units/mg, about 0.55 units/mg, about 0.6 units/mg, about 0.65 units/mg, about 0.7 units/mg, about 0.75 units/mg, about 0.8 units/mg, or more, or any range of values thereof. In some embodiments, the DHAD variant proteins have a specific activity of about 0.10 units/mg to about 0.8 units/mg, about 0.2 units/mg to about 0.8 units/mg, about 0.3 units/mg to about 0.8 units/mg, about 0.4 units/mg to about 0.8 units/mg, or about 0.1 units/mg to about 0.5 units/mg. In other embodiments, DHAD activity is increased in the DHAD variant by at least 10%, at least 20%, at least 30%, at least 40%, at least 50%, at least 60%, at least 70%, at least 80%, at least 90%, or at least 100%, or more, compared to DHAD proteins without an amino acid deletion, or any range of values thereof. In other embodiments, DHAD activity is increased in the DHAD variant by about 10%, about 20%, about 30%, about 40%, about 50%, about 60%, about 70%, about 80%, about 90%, about 100%, or more, compared to DHAD proteins without an amino acid deletion, or any range of values thereof. In some embodiments, DHAD activity is increased in the DHAD variant by about 10% to about 100%, about 20% to about 100%, about 30% to about 100%, about 40% to about 100%, about 50% to about 100%, about 60% to about 100%, about 10% to about 60%, about 20% to about 60%, about 30% to about 60%, about 40% to about 50%, or about 50% to about 60% compared to DHAD proteins without an amino acid deletion.

DHAD Proteins

Any DHAD proteins may be used as a parental, or starting, molecule for creating a DHAD variant polypeptide of the invention. DHADs that may be used herein can be derived from bacterial, fungal, or plant sources. DHADs that may be used may have a $[4Fe-4S]^{2+}$ cluster or a $[2Fe-2S]^{2+}$ cluster bound by the apoprotein. Tables 3-5 list SEQ ID NOs for coding regions and proteins of representative DHADs that may be used in the present invention. Proteins with at least about 95% identity to those listed sequences have generally been omitted for simplification, but it is understood that the omitted proteins with at least about 95% sequence identity to any of the proteins listed in Tables 3-5 and having DHAD activity may be used as disclosed herein. As described herein, polynucleotide sequences encoding DHADs can be codon optimized for expression in a particular organism by methods known in the art. Examples of such DHAD sequences include, for example, *Streptococcus downei* (*S. downei*) (DNA SEQ ID NO:708; protein SEQ ID NO:709), *Oscillatoria* species PCC 6506 (DNA SEQ ID NO:710; protein SEQ ID NO:711), *Zea mays* (DNA SEQ ID NO:712; protein SEQ ID NO:713), *Lactococcus lactis* (DNA SEQ ID NO:714; protein SEQ ID NO:715), *Neurospora crassa* (DNA SEQ ID NOs:716 and 718; protein SEQ ID NOs:717 and 719) and *S. mutans* DHAD 689-I2V5 variant (DNA SEQ ID NO:786; protein SEQ ID NO:787). Other examples of DHADs include, for example, *Streptococcus macacae* DHAD (*S. macacae*) (DNA SEQ ID NO:700; protein SEQ ID NO:701), *S. macacae* DHAD L2V4 (DNA SEQ ID NO:702; protein SEQ ID NO:703), *S. macacae* DHAD I2V5 (DNA SEQ ID NO:704; protein SEQ ID NO:705) and S, mutans DHAD 689-I2V5 variant (DNA SEQ ID NO:706; protein SEQ ID NO:707). Additional DHAD proteins and their encoding sequences can be identified by BLAST searching of public databases, as well known to one skilled in the art. Typically BLAST (described above) searching of publicly available databases with known DHAD sequences, such as those provided herein, is used to identify DHADs and their encoding sequences that can be expressed in the present cells. For example, DHAD proteins having amino acid sequence identities of at least about 80-85%, at least about 85-90%, at least about 90-95%, or at least about 98% sequence identity to any of the DHAD proteins disclosed herein can be expressed in the present cells. Identities are based on the Clustal W method of alignment using the default parameters of GAP PENALTY=10, GAP LENGTH PENALTY=0.1, and Gonnet 250 series of protein weight matrix.

TABLE 3

SEQ ID NOs of Representative Bacterial [2Fe—2S]$^{2+}$ DHAD Proteins and Encoding Sequences

| Organism of derivation | SEQ ID NO: Nucleic acid | SEQ ID NO: Peptide |
|---|---|---|
| *Mycobacterium* sp. MCS | 1 | 2 |
| *Mycobacterium gilvum* PYR-GCK | 3 | 4 |
| *Mycobacterium smegmatis* str. MC2 155 | 5 | 6 |
| *Mycobacterium vanbaalenii* PYR-1 | 7 | 8 |
| *Nocardia farcinica* IFM 10152 | 9 | 10 |
| *Rhodococcus* sp. RHA1 | 11 | 12 |
| *Mycobacterium ulcerans* Agy99 | 13 | 14 |
| *Mycobacterium avium* subsp. paratuberculosis K-10 | 15 | 16 |
| *Mycobacterium tuberculosis* H37Ra | 17 | 18 |
| *Mycobacterium leprae* TN * | 19 | 20 |
| *Kineococcus radiotolerans* SRS30216 | 21 | 22 |
| *Janibacter* sp. HTCC2649 | 23 | 24 |
| *Nocardioides* sp. JS614 | 25 | 26 |
| *Renibacterium salmoninarum* ATCC 33209 | 27 | 28 |
| *Arthrobacter aurescens* TC1 | 29 | 30 |
| *Leifsonia xyli* subsp. *xyli* str. CTCB07 | 31 | 32 |
| marine actinobacterium PHSC20C1 | 33 | 34 |
| *Clavibacter michiganensis* subsp. *michiganensis* NCPPB 382 | 35 | 36 |
| *Saccharopolyspora erythraea* NRRL 2338 | 37 | 38 |
| *Acidothermus cellulolyticus* 11B | 39 | 40 |
| *Corynebacterium efficiens* YS-314 | 41 | 42 |
| *Brevibacterium linens* BL2 | 43 | 44 |
| *Tropheryma whipplei* TW08/27 | 45 | 46 |
| *Methylobacterium extorquens* PA1 | 47 | 48 |
| *Methylobacterium nodulans* ORS 2060 | 49 | 50 |
| *Rhodopseudomonas palustris* BisB5 | 51 | 52 |
| *Rhodopseudomonas palustris* BisB18 | 53 | 54 |
| *Bradyrhizobium* sp. ORS278 | 55 | 56 |
| *Bradyrhizobium japonicum* USDA 110 | 57 | 58 |
| *Fulvimarina pelagi* HTCC2506 | 59 | 60 |
| *Aurantimonas* sp. SI85-9A1 | 61 | 62 |
| *Hoeflea phototrophica* DFL-43 | 63 | 64 |
| *Mesorhizobium loti* MAFF303099 | 65 | 66 |
| *Mesorhizobium* sp. BNC1 | 67 | 68 |
| *Parvibaculum lavamentivorans* DS-1 | 69 | 70 |
| *Loktanella vestfoldensis* SKA53 | 71 | 72 |
| *Roseobacter* sp. CCS2 | 73 | 74 |
| *Dinoroseobacter shibae* DFL 12 | 75 | 76 |
| *Roseovarius nubinhibens* ISM | 77 | 78 |
| *Sagittula stellata* E-37 | 79 | 80 |
| *Roseobacter* sp. AzwK-3b | 81 | 82 |
| *Roseovarius* sp. TM1035 | 83 | 84 |
| *Oceanicola batsensis* HTCC2597 | 85 | 86 |
| *Oceanicola granulosus* HTCC2516 | 87 | 88 |
| Rhodobacterales bacterium HTCC2150 | 89 | 90 |
| *Paracoccus denitrificans* PD1222 | 91 | 92 |
| *Oceanibulbus indolifex* HEL-45 | 93 | 94 |
| *Sulfitobacter* sp. EE-36 | 95 | 96 |
| *Roseobacter denitrificans* OCh 114 | 97 | 98 |
| *Jannaschia* sp. CCS1 | 99 | 100 |
| *Caulobacter* sp. K31 | 101 | 102 |
| Candidatus *Pelagibacter ubique* HTCC1062 | 103 | 104 |
| *Erythrobacter litoralis* HTCC2594 | 105 | 106 |
| *Erythrobacter* sp. NAP1 | 107 | 108 |
| *Comamonas testosterone* KF-1 | 109 | 110 |
| *Sphingomonas wittichii* RW1 | 111 | 112 |
| *Burkholderia xenovorans* LB400 | 113 | 114 |

TABLE 3-continued

SEQ ID NOs of Representative Bacterial [2Fe—2S]$^{2+}$ DHAD Proteins and Encoding Sequences

| Organism of derivation | SEQ ID NO: Nucleic acid | SEQ ID NO: Peptide |
|---|---|---|
| *Burkholderia phytofirmans* PsJN | 115 | 116 |
| *Bordetella petrii* DSM 12804 | 117 | 118 |
| *Bordetella bronchiseptica* RB50 | 119 | 120 |
| *Bradyrhizobium* sp. ORS278 | 121 | 122 |
| *Bradyrhizobium* sp. BTAi1 | 123 | 124 |
| *Bradyrhizobium japonicum* | 125 | 126 |
| *Sphingomonas wittichii* RW1 | 127 | 128 |
| *Rhodobacterales* bacterium HTCC2654 | 129 | 130 |
| *Solibacter usitatus* Ellin6076 | 131 | 132 |
| *Roseiflexus* sp. RS-1 | 133 | 134 |
| *Rubrobacter xylanophilus* DSM 9941 | 135 | 136 |
| *Salinispora tropica* CNB-440 | 137 | 138 |
| *Acidobacteria* bacterium Ellin345 | 139 | 140 |
| *Thermus thermophilus* HB27 | 141 | 142 |
| *Maricaulis maris* MCS10 | 143 | 144 |
| *Parvularcula bermudensis* HTCC2503 | 145 | 146 |
| *Oceanicaulis alexandrii* HTCC2633 | 147 | 148 |
| *Plesiocystis pacifica* SIR-1 | 149 | 150 |
| *Bacillus* sp. NRRL B-14911 | 151 | 152 |
| *Oceanobacillus iheyensis* HTE831 | 153 | 154 |
| *Staphylococcus saprophyticus* subsp. *saprophyticus* ATCC 15305 | 155 | 156 |
| *Bacillus selenitireducens* MLS10 | 157 | 158 |
| *Streptococcus pneumoniae* SP6-BS73 | 159 | 160 |
| *Streptococcus sanguinis* SK36 | 161 | 162 |
| *Streptococcus thermophilus* LMG 18311 | 163 | 164 |
| *Streptococcus suis* 89/1591 | 165 | 166 |
| *Streptococcus mutans* UA159 | 167 | 168 |
| *Leptospira borgpetersenii* serovar Hardjo-bovis L550 | 169 | 170 |
| Candidatus *Vesicomyosocius okutanii* HA | 171 | 172 |
| Candidatus *Ruthia magnifica* str. Cm (*Calyptogena magnifica*) | 173 | 174 |
| *Methylococcus capsulatus* str. Bath | 175 | 176 |
| uncultured marine bacterium EB80_02D08 | 177 | 178 |
| uncultured marine gamma proteobacterium EBAC31A08 | 179 | 180 |
| uncultured marine gamma proteobacterium EBAC20E09 | 181 | 182 |
| uncultured gamma proteobacterium eBACHOT4E07 | 183 | 184 |
| *Alcanivorax borkumensis* SK2 | 185 | 186 |
| *Chromohalobacter salexigens* DSM 3043 | 187 | 188 |
| *Marinobacter algicola* DG893 | 189 | 190 |
| *Marinobacter aquaeolei* VT8 | 191 | 192 |
| *Marinobacter* sp. ELB17 | 193 | 194 |
| *Pseudoalteromonas haloplanktis* TAC125 | 195 | 196 |
| *Acinetobacter* sp. ADP1 | 197 | 198 |
| *Opitutaceae* bacterium TAV2 | 199 | 200 |
| *Flavobacterium* sp. MED217 | 201 | 202 |
| *Cellulophaga* sp. MED134 | 203 | 204 |
| *Kordia algicida* OT-1 | 205 | 206 |
| *Flavobacteriales* bacterium ALC-1 | 207 | 208 |
| *Psychroflexus torquis* ATCC 700755 | 209 | 210 |
| *Flavobacteriales* bacterium HTCC2170 | 211 | 212 |
| unidentified eubacterium SCB49 | 213 | 214 |
| *Gramella forsetii* KT0803 | 215 | 216 |
| *Robiginitalea biformata* HTCC2501 | 217 | 218 |
| *Tenacibaculum* sp. MED152 | 219 | 220 |
| *Polaribacter irgensii* 23-P | 221 | 222 |
| *Pedobacter* sp. BAL39 | 223 | 224 |
| *Flavobacteria* bacterium BAL38 | 225 | 226 |
| *Flavobacterium psychrophilum* JIP02/86 | 227 | 228 |
| *Flavobacterium johnsoniae* UW101 | 229 | 230 |
| *Lactococcus lactis* subsp. *cremoris* SK11 | 231 | 232 |
| *Psychromonas ingrahamii* 37 | 233 | 234 |
| *Microscilla marina* ATCC 23134 | 235 | 236 |
| *Cytophaga hutchinsonii* ATCC 33406 | 237 | 238 |
| *Rhodopirellula baltica* SH 1 | 239 | 240 |
| *Blastopirellula marina* DSM 3645 | 241 | 242 |
| *Planctomyces maris* DSM 8797 | 243 | 244 |
| *Algoriphagus* sp. PR1 | 245 | 246 |
| Candidatus *Sulcia muelleri* str. Hc (*Homalodisca coagulata*) | 247 | 248 |
| Candidatus *Carsonella ruddii* PV | 249 | 250 |
| *Synechococcus* sp. RS9916 | 251 | 252 |
| *Synechococcus* sp. WH 7803 | 253 | 254 |
| *Synechococcus* sp. CC9311 | 255 | 256 |
| *Synechococcus* sp. CC9605 | 257 | 258 |
| *Synechococcus* sp. WH 8102 | 259 | 260 |
| *Synechococcus* sp. BL107 | 261 | 262 |
| *Synechococcus* sp. RCC307 | 263 | 264 |
| *Synechococcus* sp. RS9917 | 265 | 266 |
| *Synechococcus* sp. WH 5701 | 267 | 268 |
| *Prochlorococcus marinus* str. MIT 9313 | 269 | 270 |
| *Prochlorococcus marinus* str. NATL2A | 271 | 272 |
| *Prochlorococcus marinus* str. MIT 9215 | 273 | 274 |
| *Prochlorococcus marinus* str. AS9601 | 275 | 276 |
| *Prochlorococcus marinus* str. MIT 9515 | 277 | 278 |
| *Prochlorococcus marinus* subsp. *pastoris* str. CCMP1986 | 279 | 280 |
| *Prochlorococcus marinus* str. MIT 9211 | 281 | 282 |
| *Prochlorococcus marinus* subsp. *marinus* str. CCMP1375 | 283 | 284 |
| *Nodularia spumigena* CCY9414 | 285 | 286 |
| *Nostoc punctiforme* PCC 73102 | 287 | 288 |
| *Nostoc* sp. PCC 7120 | 289 | 290 |
| *Trichodesmium erythraeum* IMS101 | 291 | 292 |
| *Acaryochloris marina* MBIC11017 | 293 | 294 |
| *Lyngbya* sp. PCC 8106 | 295 | 296 |
| *Synechocystis* sp. PCC 6803 | 297 | 298 |
| *Cyanothece* sp. CCY0110 | 299 | 300 |
| *Thermosynechococcus elongatus* BP-1 | 301 | 302 |
| *Synechococcus* sp. JA-2-3B'a(2-13) | 303 | 304 |
| *Gloeobacter violaceus* PCC 7421 | 305 | 306 |
| *Nitrosomonas eutropha* C91 | 307 | 308 |
| *Nitrosomonas europaea* ATCC 19718 | 309 | 310 |
| *Nitrosospira multiformis* ATCC 25196 | 311 | 312 |
| *Chloroflexus aggregans* DSM 9485 | 313 | 314 |
| *Leptospirillum* sp. Group II UBA | 315 | 316 |
| *Leptospirillum* sp. Group II UBA | 317 | 318 |
| *Halorhodospira halophila* SL1 | 319 | 320 |
| *Nitrococcus mobilis* Nb-231 | 321 | 322 |
| *Alkalilimnicola ehrlichei* MLHE-1 | 323 | 324 |
| *Deinococcus geothermalis* DSM 11300 | 325 | 326 |
| *Polynucleobacter* sp. QLW-P1DMWA-1 | 327 | 328 |
| *Polynucleobacter necessarius* STIR1 | 329 | 330 |
| *Azoarcus* sp. EbN1 | 331 | 332 |
| *Burkholderia phymatum* STM815 | 333 | 334 |
| *Burkholderia xenovorans* LB400 | 335 | 336 |
| *Burkholderia multivorans* ATCC 17616 | 337 | 338 |
| *Burkholderia cenocepacia* PC184 | 339 | 340 |
| *Burkholderia mallei* GB8 horse 4 | 341 | 342 |
| *Ralstonia eutropha* JMP134 | 343 | 344 |
| *Ralstonia metallidurans* CH34 | 345 | 346 |
| *Ralstonia solanacearum* UW551 | 347 | 348 |
| *Ralstonia pickettii* 12J | 349 | 350 |
| *Limnobacter* sp. MED105 | 351 | 352 |
| *Herminiimonas arsenicoxydans* | 353 | 354 |
| *Bordetella parapertussis* | 355 | 356 |
| *Bordetella petrii* DSM 12804 | 357 | 358 |
| *Polaromonas* sp. JS666 | 359 | 360 |
| *Polaromonas naphthalenivorans* CJ2 | 361 | 362 |
| *Rhodoferax ferrireducens* T118 | 363 | 364 |
| *Verminephrobacter eiseniae* EF01-2 | 365 | 366 |
| *Acidovorax* sp. JS42 | 367 | 368 |
| *Delftia acidovorans* SPH-1 | 369 | 370 |
| *Methylibium petroleiphilum* PM1 | 371 | 372 |
| gamma proteobacterium KT 71 | 373 | 374 |
| *Tremblaya princeps* | 375 | 376 |
| *Blastopirellula marina* DSM 3645 | 377 | 378 |
| *Planctomyces maris* DSM 8797 | 379 | 380 |
| *Microcystis aeruginosa* PCC 7806 | 381 | 382 |
| *Salinibacter ruber* DSM 13855 | 383 | 384 |
| *Methylobacterium chloromethanicum* | 385 | 386 |

TABLE 4

SEQ ID NOs of Representative Fungal and Plant [2Fe—2S]$^{2+}$ DHAD Proteins and Encoding Sequences

| Description | SEQ ID NO: Nucleic acid | SEQ ID NO: Peptide |
|---|---|---|
| Schizosaccharomyces pombe ILV3 | 387 | 388 |
| Saccharomyces cerevisiae ILV3 | 389 | 390 |
| Kluyveromyces lactis ILV3 | 391 | 392 |
| Candida albicans SC5314 ILV3 | 393 | 394 |
| Pichia stipitis CBS 6054 ILV3 | 395 | 396 |
| Yarrowia lipolytica ILV3 | 397 | 398 |
| Candida glabrata CBS 138 ILV3 | 399 | 400 |
| Chlamydomonas reinhardtii | 401 | 402 |
| Ostreococcus lucimarinus CCE9901 | 403 | 404 |
| Vitis vinifera (Unnamed protein product: CAO71581.1) | 405 | 406 |
| Vitis vinifera (Hypothetical protein: CAN67446.1) | 407 | 408 |
| Arabidopsis thaliana | 409 | 410 |
| Oryza sativa (indica cultivar-group) | 411 | 412 |
| Physcomitrella patens subsp. patens | 413 | 414 |
| Chaetomium globosum CBS 148.51 | 415 | 416 |
| Neurospora crassa OR74A | 417 | 418 |
| Magnaporthe grisea 70-15 | 419 | 420 |
| Gibberella zeae PH-1 | 421 | 422 |
| Aspergillus niger | 423 | 424 |
| Neosartorya fischeri NRRL 181 (XP_001266525.1) | 425 | 426 |
| Neosartorya fischeri NRRL 181 (XP_001262996.1) | 427 | 428 |
| Aspergillus niger (hypothetical protein An03g04520) | 429 | 430 |
| Aspergillus niger (Hypothetical protein An14g03280) | 431 | 432 |
| Aspergillus terreus NIH2624 | 433 | 434 |
| Aspergillus clavatus NRRL 1 | 435 | 436 |
| Aspergillus nidulans FGSC A4 | 437 | 438 |
| Aspergillus oryzae | 439 | 440 |
| Ajellomyces capsulatus NAm1 | 441 | 442 |
| Coccidioides immitis RS | 443 | 444 |
| Botryotinia fuckeliana B05.10 | 445 | 446 |
| Phaeosphaeria nodorum SN15 | 447 | 448 |
| Pichia guilliermondii ATCC 6260 | 449 | 450 |
| Debaryomyces hansenii CBS767 | 451 | 452 |
| Lodderomyces elongisporus NRRL YB-4239 | 453 | 454 |
| Vanderwaltozyma polyspora DSM 70294 | 455 | 456 |
| Ashbya gossypii ATCC 10895 | 457 | 458 |
| Laccaria bicolor S238N-H82 | 459 | 460 |
| Coprinopsis cinerea okayama7#130 | 461 | 462 |
| Cryptococcus neoformans var. neoformans JEC21 | 463 | 464 |
| Ustilago maydis 521 | 465 | 466 |
| Malassezia globosa CBS 7966 | 467 | 468 |
| Aspergillus clavatus NRRL 1 | 469 | 470 |
| Neosartorya fischeri NRRL 181 (Putative) | 471 | 472 |
| Aspergillus oryzae | 473 | 474 |
| Aspergillus niger (hypothetical protein An18g04160) | 475 | 476 |
| Aspergillus terreus NIH2624 | 477 | 478 |
| Coccidioides immitis RS (hypothetical protein CIMG_04591) | 479 | 480 |
| Paracoccidioides brasiliensis | 481 | 482 |
| Phaeosphaeria nodorum SN15 | 483 | 484 |
| Gibberella zeae PH-1 | 485 | 486 |
| Neurospora crassa OR74A | 487 | 488 |
| Coprinopsis cinerea okayama 7#130 | 489 | 490 |
| Laccaria bicolor S238N-H82 | 491 | 492 |
| Ustilago maydis 521 | 493 | 494 |

TABLE 5

SEQ ID NOs of Representative [4Fe—4S]$^{2+}$ DHAD Proteins and Encoding Sequences

| Organism | SEQ ID NO: Nucleic acid | SEQ ID NO: Peptide |
|---|---|---|
| Escherichia coli str. K-12 substr. MG1655 | 495 | 496 |
| Bacillus subtilis subsp. subtilis str. 168 | 497 | 498 |
| Agrobacterium tumefaciens str. C58 | 499 | 500 |
| Burkholderia cenocepacia MC0-3 | 501 | 502 |
| Psychrobacter cryohalolentis K5 | 503 | 504 |
| Psychromonas sp. CNPT3 | 505 | 506 |
| Deinococcus radiodurans R1 | 507 | 508 |
| Wolinella succinogenes DSM 1740 | 509 | 510 |
| Zymomonas mobilis subsp. mobilis ZM4 | 511 | 512 |
| Clostridium acetobutylicum ATCC 824 | 513 | 514 |
| Clostridium beijerinckii NCIMB 8052 | 515 | 516 |
| Pseudomonas fluorescens Pf-5 | 517 | 518 |
| Methanococcus maripaludis C7 | 519 | 520 |
| Methanococcus aeolicus Nankai-3 | 521 | 522 |
| Vibrio fischeri ATCC 700601 (ES114) | 523 | 524 |
| Shewanella oneidensis MR-1 ATCC 700550 | 525 | 526 |

Additional [2Fe-2S]$^{2+}$ DHADs can be identified using the analysis described in co-pending U.S. Appl. Pub. No. 2010/0081154, which is herein incorporated by reference. The analysis is as follows: A Profile Hidden Markov Model (HMM) was prepared based on amino acid sequences of eight functionally verified DHADs. These DHADs are from *Nitrosomonas europaea* (DNA SEQ ID NO:309; protein SEQ ID NO:310), *Synechocystis* sp. PCC6803 (DNA SEQ ID:297; protein SEQ ID NO:298), *Streptococcus mutans* (DNA SEQ ID NO:167; protein SEQ ID NO:168), *Streptococcus thermophilus* (DNA SEQ ID NO:163; protein SEQ ID NO:164), *Ralstonia metallidurans* (DNA SEQ ID NO:345; protein SEQ ID NO:346), *Ralstonia eutropha* (DNA SEQ ID NO:343; protein SEQ ID NO:344), and *Lactococcus lactis* (DNA SEQ ID NO:231; protein SEQ ID NO:232). In addition, the DHAD from *Flavobacterium johnsoniae* (DNA SEQ ID NO:229; protein SEQ ID NO:230) was found to have DHAD activity when expressed in *Escherichia coli* and was used in making the Profile.

The Profile HMM was built as follows:

Step 1. Build a Sequence Alignment

The eight sequences for the functionally verified DHADs listed above were aligned using Clustal W with default parameters.

Step 2. Build a Profile HMM

The hmmbuild program was run on the set of aligned sequences using default parameters. hmmbuild reads the multiple sequence alignment file, builds a new Profile HMM, and saves the Profile HMM to file. Using this program an un-calibrated profile was generated from the multiple alignment for each set of subunit sequences described above.

The following information based on the HMMER software user guide gives some description of the way that the hmmbuild program prepares a Profile 1-MM. A Profile HMM is capable of modeling gapped alignments, e.g., including insertions and deletions, which lets the software describe a complete conserved domain (rather than just a small ungapped motif). Insertions and deletions are modeled using insertion (I) states and deletion (D) states. All columns that contain more than a certain fraction x of gap characters will be assigned as an insert column. By default, x is set to 0.5. Each match state has an I and a D state associated with it. HMMER calls a group of three states (M/D/I) at the same consensus position in the alignment a "node". These states are interconnected with arrows called state transition probabilities. M and I states are emitters, while D states are silent. The transitions are arranged so that at each node, either the M state is used (and a residue is aligned and scored) or the D state is used (and no residue is aligned, resulting in a deletion-gap character, '-'). Insertions occur between nodes, and I states have a self-transition, allowing one or more inserted residues to occur between consensus columns.

The scores of residues in a match state (i.e., match state emission scores), or in an insert state (i.e., insert state emission scores) are proportional to Log_2 (p_x)/(null_x). Where p_x is the probability of an amino acid residue, at a particular position in the alignment, according to the Profile HMM and null_x is the probability according to the Null model. The Null model is a simple one state probabilistic model with pre-calculated set of emission probabilities for each of the 20 amino acids derived from the distribution of amino acids in the SWISSPROT release 24.

State transition scores are also calculated as log odds parameters and are proportional to Log_2 (t_x). Where t_x is the probability of transiting to an emitter or non-emitter state.

Step 3. Calibrate the Profile HMM

The Profile HMM was read using hmmcalibrate which scores a large number of synthesized random sequences with the Profile (the default number of synthetic sequences used is 5,000), fits an extreme value distribution (EVD) to the histogram of those scores, and re-saves the HMM file now including the EVD parameters. These EVD parameters (μ and π) are used to calculate the E-values of bit scores when the profile is searched against a protein sequence database. hmmcalibrate writes two parameters into the HMM file on a line labeled "EVD": these parameters are the μ (location) and λ (scale) parameters of an extreme value distribution (EVD) that best fits a histogram of scores calculated on randomly generated sequences of about the same length and residue composition as SWISS-PROT. This calibration was done once for the Profile HMM.

The calibrated Profile HMM for the DHAD set of sequences is provided in Table 6. The Profile HMM is provided in a chart that gives the probability of each amino acid occurring at each position in the amino acid sequence. The highest probability is highlighted for each position. The first line for each position reports the match emission scores: probability for each amino acid to be in that state (highest score is highlighted). The second line reports the insert emission scores, and the third line reports on state transition scores: M→M, M→I, M→D; I→M, I→I; D→M, D→D; B→M; M→E.

For example, the DHAD Profile HMM shows that methionine has a 1757 probability of being in the first position, the highest probability which is highlighted. In the second position glutamic acid has the highest probability, which is 1356. In the third position lysine has the highest probability, which is 1569.

Step 4. Test the Specificity and Sensitivity of the Built Profile HMMs

The Profile HMM was evaluated using hmmsearch, which reads a Profile HMM from hmmfile and searches a sequence file for significantly similar sequence matches. The sequence file searched contained 976 sequences (see above). During the search, the size of the database (Z parameter) was set to 1 billion. This size setting ensures that significant E-values against the current database will remain significant in the foreseeable future. The E-value cutoff was set at 10.

A hmmer search with the Profile HMM generated from the alignment of the eight DHADs with experimentally verified function, matched all 976 sequences with an E value $<10^{-5}$. This result indicates that members of the dehydratase superfamily share significant sequence similarity. A hmmer search with a cutoff of E value $10^{-5}$ was used to separate DHAD related dehydratases from other more remote but related proteins, as described above.

The Profile HMM is prepared using the HMMER software package (The theory behind profile HMMs is described in R. Durbin, S. Eddy, A. Krogh, and G. Mitchison, Biological sequence analysis: probabilistic models of proteins and nucleic acids, Cambridge University Press, 1998; Krogh et al., 1994; J. Mol. Biol. 235:1501-1531), following the user guide which is available from HMMER (Janelia Farm Research Campus, Ashburn, Va.). The output of the HMMER software program is a Profile Hidden Markov Model (HMM) that characterizes the input sequences. The Profile HMM prepared for the eight DHAD proteins is given in Table 6.

This Profile HMM for DHADs can be used to identify DHAD related proteins. Any protein that matches the Profile HMM with an E value of $<10^{-5}$ is a DHAD related protein, which includes [4Fe-4S]$^{2+}$ DHADs, [2Fe-2S]$^{2+}$ DHADs, aldonic acid dehydratases, and phosphogluconate dehydratases.

Sequences matching the Profile HMM given herein are then analyzed for the presence of the three conserved cysteines described above. The exact positions of the three conserved cysteines can vary, and these can be identified in the context of the surrounding sequence using multiple sequence alignments performed with the Clustal W algorithm (Thompson, J. D., Higgins, D. G., and Gibson T. J. (1994) Nuc. Acid Res. 22: 4673 4680) employing the following parameters: 1) for pairwise alignment parameters, a Gap opening=10; Gap extend=0.1; matrix is Gonnet 250; and mode—Slow-accurate, 2) for multiple alignment parameters, Gap opening=10; Gap extension=0.2; and matrix is Gonnet series. For example, the three conserved cysteines are located at amino acid positions 56, 129, and 201 in the *Streptococcus mutans* (*S. mutans*) DHAD (SEQ ID NO:168), and at amino acid positions 61, 135, and 207 in the *Lactococcus lactis* (*L. lactis*) DHAD (SEQ ID NO:232). The exact positions of the three conserved cysteines in other protein sequences correspond to these positions in the *S. mutans* or the *L. lactis* amino acid sequence. One skilled in the art will readily be able to identify the presence or absence of each of the three conserved cysteines in the amino acid sequence of a DHAD protein using pairwise or multiple sequence alignments. In addition, other methods can be used to determine the presence of the three conserved cysteines, such as analysis by eye.

The DHAD Profile HMM matching proteins that have two but not the third (position 56) conserved cysteine include [4Fe-4S]$^{2+}$ DHADs and phosphogluconate dehydratases (EDDs). Proteins having the three conserved cysteines include arabonate dehydratases and [2Fe-2S]$^{2+}$ DHADs, and are members of a [2Fe-2S]$^{2+}$ DHAD/aldonic acid dehydratase group. The [2Fe-2S]$^{2+}$ DHADs can be distinguished from the aldonic acid dehydratases by analyzing for signature conserved amino acids found to be present in the [2Fe-2S]$^{2+}$ DHADs or in the aldonic acid dehydratases at positions corresponding to the following positions in the *Streptococcus mutans* DHAD amino acid sequence. These signature amino acids are in [2Fe-2S]$^{2+}$ DHADs or in aldonic acid dehydratases, respectively, at the following positions (with greater than 90% occurrence): 88 asparagine vs. glutamic acid; 113 not conserved vs. glutamic acid; 142 arginine or asparagine vs. not conserved; 165: not conserved vs. glycine; 208 asparagine vs. not conserved;

454 leucine vs. not conserved; 477 phenylalanine or tyrosine vs. not conserved; and 487 glycine vs. not conserved.

The disclosed methods for identification of $[2Fe-2S]^{2+}$ DHAD enzymes can be carried out on a single sequence or on a group of sequences. In a preferred embodiment, one or more sequence databases are queried with a Profile HMM as described herein.

Additionally, the sequences of DHAD coding regions provided herein can be used to identify other homologs in nature. Such methods are well-known in the art, and various methods that can be used to isolate genes encoding homologous proteins are described in U.S. Appl. Pub. No. 2010/0081154, which such methods are incorporated by reference herein.

DHAD variant polypeptides provided herein may be, for example, of a size of about 10 or more, about 20 or more, about 25 or more, about 50 or more, about 75 or more, about 100 or more, about 200 or more, about 500 or more, about 1,000 or more, or about 2,000 or more amino acids. Polypeptides can have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

Also provided are active fragments of the DHAD variant polypeptides. A "fragment" is a unique portion of a polypeptide or other enzyme used in the invention which is identical in sequence to but shorter in length than the parent full-length sequence. A fragment can comprise up to the entire length of the defined sequence, minus one amino acid residue. For example, a fragment can comprise from about 5 to about 1,000 contiguous amino acid residues. A fragment can be, for example, at least 5, 10, 15, 20, 25, 30, 40, 50, 60, 75, 100, 150, 250, 500, 750, or 1,000 contiguous amino acid residues in length. Fragments can be preferentially selected from certain regions of a molecule. For example, a polypeptide fragment can comprise a certain length of contiguous amino acids selected from the first 100, 200, 300, 400, or 500 amino acids of a polypeptide as shown in a certain defined sequence. Alternatively, a polypeptide fragment can comprise a certain length of contiguous amino acids selected from the last 100, 200, 300, 400, or 500 amino acids of a polypeptide as shown in a certain defined sequence. Clearly these lengths are exemplary, and any length that is supported by the specification, including the Sequence Listing, tables, and figures, can be encompassed by the present embodiments. An exemplary DHAD fragment encompassed by the present invention is the *Streptococcus mutans* DHAD enzyme (Amino Acid: SEQ ID NO:544; Nucleic Acid: SEQ ID NO:543) lacking the last 9 amino acids from the C-terminus ("the Δ9 variant"; Amino Acid: SEQ ID NO:546; Nucleic Acid: SEQ ID NO:545). In certain embodiments, the DHAD variant polypeptide fragments have DHAD activity, and thus are capable of catalyzing the conversion of 2,3-dihydroxyisovalerate to α-ketoisovalerate.

The DHAD variant polypeptides of the invention can further comprise a label (such as for detection) or peptide tag. Peptide tags can include, for example, a polyhistidine tag, a polycysteine tag, a V5 epitope, a myc epitope, or a sequence comprising a Lumio™ tag (protein SEQ ID NOs: 589 or 720; DNA SEQ ID NO:721). A detectable label can include, for example, an enzyme, a substrate for an enzyme, a fluorescent compound, a luminescent compound, a chemiluminescent compound, a radionuclide, a paramagnetic compound, or biotin.

DHAD Activity Assays

The presence of DHAD activity in a cell engineered to express a heterologous DHAD can be confirmed using methods known in the art and/or described herein. As one example, crude extracts from cells engineered to express a bacterial DHAD can be used in a DHAD assay as described in the Examples herein or as described by Flint and Emptage (*J. Biol. Chem.* (1988) 263(8): 3558-64) using dinitrophenylhydrazine. In another example, DHAD activity can be assayed by the methods disclosed in U.S. App. Pub. No. US20100081154, incorporated herein by reference, in a yeast strain that lacks endogenous DHAD activity. In such a yeast strain, if sufficient DHAD activity is present, the yeast strain will grow in the absence of branched-chain amino acids. DHAD activity can also be confirmed by more indirect methods, such as by assaying for a downstream product in a pathway requiring DHAD activity. Any product that has α-ketoisovalerate or α-ketomethylvalerate as a pathway intermediate can be measured in an assay for DHAD activity. A list of such products includes, but is not limited to, valine, isoleucine, leucine, pantothenic acid, 2-methyl-1-butanol, 3-methyl-1-butanol, and isobutanol.

Nucleic Acid Molecules

Provided herein are isolated nucleic acid molecules that encode for the above-described DHAD variant polypeptides. The coding region of the isolated nucleic acid encoding the DHAD variant can be codon optimized for a particular target host cell, as well known to one skilled in the art. The isolated nucleic acid molecules of the invention can be comprised in a vector. Vectors useful for the transformation of a variety of host cells are common and commercially available from companies such as Epicentre™ (Madison, Wis.), Invitrogen Corp. (Carlsbad, Calif.), Stratagene (La Jolla, Calif.), and New England Biolabs, Inc. (Beverly, Mass.). Typically, the vector contains a selectable marker and sequences allowing autonomous replication or chromosomal integration in the desired host. In addition, suitable vectors comprise a promoter region which harbors transcriptional initiation controls and a transcriptional termination control region, between which a coding region DNA fragment can be inserted, to provide expression of the inserted coding region. Both control regions can be derived from genes homologous to the transformed host cell, although it is to be understood that such control regions can also be, for example, derived from genes that are not native to the specific species chosen as a host.

Initiation control regions or promoters, which are useful to drive expression of bacterial DHAD variant coding regions in the desired bacterial host cell are numerous and familiar to those skilled in the art. Virtually any promoter capable of driving these genetic elements is suitable for the present invention including, but not limited to, lac, ara, tet, trp, $IP_L$, $IP_R$, T7, tac, and trc promoters (useful for expression in *Escherichia coli, Alcaligenes,* and *Pseudomonas*); the amy, apr, and npr promoters, and various phage promoters useful for expression in *Bacillus subtilis, Bacillus licheniformis,* and *Paenibacillus macerans*; nisA (useful for expression Gram-positive bacteria, Eichenbaum et al. Appl. Environ. Microbiol. 64(8):2763-2769 (1998)); and the synthetic P11 promoter (useful for expression in *Lactobacillus plantarum*, Rud et al., Microbiology 152:1011-1019 (2006)). In addition, the ldhL1 and fabZ1 promoters of *L. plantarum* are useful for expression of chimeric genes in bacteria. The fabZ1 promoter directs transcription of an operon with the first gene, fabZ1, encoding (3R)-hydroxymyristoyl-[acyl carrier protein]dehydratase. Termination control regions can also be derived from various genes, typically from genes native to the preferred hosts. In other embodiments, a termination site is unnecessary. Optionally, a termination site can be unnecessary; however, it is most preferred if included.

Certain vectors are capable of replicating in a broad range of host bacteria and can be transferred by conjugation. The complete and annotated sequence of pRK404 and three related vectors: pRK437, pRK442, and pRK442(H), are available. These derivatives have proven to be valuable tools for genetic manipulation in Gram-negative bacteria (Scott et al., Plasmid 50(1):74-79 (2003)). Several plasmid derivatives of broad-host-range Inc P4 plasmid RSF1010 are also available with promoters that can function in a range of Gram-negative bacteria. Plasmids pAYC36 and pAYC37, have active promoters along with multiple cloning sites to allow for heterologous gene expression in Gram-negative bacteria. Some vectors that are useful for transformation of *Bacillus subtilis* and *Lactobacillus* include pAMβ1 and derivatives thereof (Renault et al., Gene 183:175-182 (1996); and O'Sullivan et al., Gene 137:227-231 (1993)); pMBB1 and pHW800, a derivative of pMBB1 (Wyckoff et al., Appl. Environ. Microbiol. 62:1481-1486 (1996)); pMG1, a conjugative plasmid (Tanimoto et al., J. Bacteriol. 184:5800-5804 (2002)); pNZ9520 (Kleerebezem et al., Appl. Environ. Microbiol. 63:4581-4584 (1997)); pAM401 (Fujimoto et al., Appl. Environ. Microbiol. 67:1262-1267 (2001)); and pAT392 (Arthur et al., Antimicrob. Agents Chemother. 38:1899-1903 (1994)). Several plasmids from *Lactobacillus plantarum* have also been reported (van Kranenburg et al., Appl. Environ. Microbiol. 71(3):1223-1230 (2005)).

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin et al., J. Bacteriol. 174(17):5633-5638 (1992)). Additionally, in vitro transposomes are available from commercial sources such as Epicentre™ to create random mutations in a variety of genomes.

Vectors suitable for expression and propagation in yeast cells are also well known. Methods for gene expression in yeast are known in the art (see, for example, Methods in Enzymology, Volume 194. Guide to Yeast Genetics and Molecular and Cell Biology (Part A, 2004, Christine Guthrie and Gerald R. Fink (Eds.), Elsevier Academic Press, San Diego, Calif.). Expression of genes in yeast typically requires a promoter, operably linked to a coding region of interest, and a transcriptional terminator. A number of yeast promoters can be used in constructing expression cassettes for genes in yeast, including, but not limited to, promoters derived from the following genes: CYC1, HIS3, GAL1, GAL10, ADH1, PGK, PHO5, GAPDH, ADC1, TRP1, URA3, LEU2, ENO, TPI, CUP1, FBA, GPD, GPM, AOX1, ILV5 and TEF(M7). Suitable transcriptional terminators include, but are not limited to, FBAt, GPDt, GPMt, ERG10t, GAL1t, CYC1, ADH1, and ILV5t.

Suitable promoters, transcriptional terminators, and a DHAD variant coding regions can be cloned into *Escherichia coli* (*E. coli*)-yeast shuttle vectors, and transformed into yeast cells, for example. These vectors allow strain propagation in both *E. coli* and yeast strains. Typically, the vector used contains a selectable marker and sequences allowing autonomous replication or chromosomal integration in the desired host. Typically used plasmids in yeast are shuttle vectors pRS423, pRS424, pRS425, pHR81, and pRS426 (American Type Culture Collection, Rockville, Md.), which contain an *E. coli* replication origin (e.g., pMB1), a yeast 2μ origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with a chimeric gene encoding the described DHAD variants can be performed, for example, by either standard molecular cloning techniques in *E. coli* or by the gap repair recombination method in yeast.

The gap repair cloning approach takes advantage of the highly efficient homologous recombination in yeast (see, e.g., Ma et al. Gene 58:201-216; 1987)). Typically, a yeast vector DNA is digested (e.g., in its multiple cloning site) to create a "gap" in its sequence. A number of insert DNAs of interest are generated that contain a 21 by sequence at both the 5' and the 3' ends that sequentially overlap with each other, and with the 5' and 3' terminus of the vector DNA. For example, to construct a yeast expression vector for "Gene X", a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 by overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g., TOP10, followed by mini preps and restriction mapping to further verify the plasmid construct. Finally, the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding region X-terminator construct is PCR amplified from a plasmid DNA construct and joined to an autotrophic marker (such as URA3) by either SOE PCR or by common restriction digests and cloning. The full cassette, containing the promoter-coding region X-terminator-URA3 region, is PCR amplified with primer sequences that contain 40-70 base pairs (bps) of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Recombinant Host Cells

The isolated nucleic acid molecules and vectors of the invention can be transformed into a host cell for DHAD expression and activity. Suitable host cells include any cell capable of genetic manipulation, and include, for example, bacteria, cyanobacteria, filamentous fungi, and yeasts.

The microbial hosts selected for the production of isobutanol are preferably tolerant to isobutanol and should be able to convert carbohydrates to isobutanol. The criteria for selection of suitable microbial hosts include, for example, the following: intrinsic tolerance to isobutanol, high rate of glucose utilization, availability of genetic tools for gene manipulation, and the ability to generate stable chromosomal alterations.

Yeast Cells

Yeast cells that can be hosts for expression of a DHAD variant of the invention are any yeast cells that are amenable to genetic manipulation and include, but are not limited to, *Saccharomyces, Schizosaccharomyces, Hansenula, Candida, Kluyveromyces, Yarrowia,* and *Pichia*. Suitable strains include, but are not limited to, *Saccharomyces cerevisiae, Schizosaccharomyces pombe, Kluyveromyces lactis, Kluyveromyces thermotolerans, Candida glabrata, Candida albicans, Pichia stipitis,* and *Yarrowia lipolytica*. In some embodiments, the yeast host is *Saccharomyces cerevisiae*. *S. cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *S. cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Expression is achieved by transforming the host cell with a gene comprising a sequence encoding any of the DHAD variants of the invention. The coding region for the DHAD to be expressed can be codon optimized for the yeast cell, as well known to one skilled in the art.

In embodiments, reducing production of an endogenous iron-sulfur (Fe—S) protein in a yeast host cell may result in an improvement in activity of an expressed heterologous Fe—S cluster protein, such as the variant DHAD enzymes of the invention. For example, in the yeast *Saccharomyces cerevisiae*, the native DHAD is encoded by ILV3, and is a mitochondrially-localized protein. The applicants have found that a *Saccharomyces cerevisiae* host cell with a heterologous DHAD expressed in the cytosol had 1.5 fold comparative activity in a mitochondrial ILV3 deletion host cell. Thus, in any of the yeast hosts described herein, an endogenous ILV3 gene can be inactivated to reduce endogenous Fe—S protein expression. ILV3 encodes mitochondrial DHAD that is involved in branched chain amino acid biosynthesis. Mitochondrial DHAD is encoded by a nuclear gene, and has a mitochondrial targeting signal sequence so that it is transported to and localized in the mitochondrion. Any ILV3 gene can be inactivated in a yeast host cell of this disclosure. Examples of yeast ILV3 inactivation target genes and their encoded proteins are those from *Saccharomyces cerevisiae* YJM78 (coding SEQ ID NO:389; protein SEQ ID NO:390), *Schizosaccharomyces pombe* (coding SEQ ID NO:387; protein SEQ ID NO:388), *Candida galbrata* strain CBS138 (coding SEQ ID NO:399; protein SEQ ID NO:400), *Candida albicans* SC5314 (coding SEQ ID NO:393; protein SEQ ID NO:394), *Kluyveromyces lactis* (coding SEQ ID NO:391; protein SEQ ID NO:392), *Yarrowia lipolytica* (coding SEQ ID NO:397; protein SEQ ID NO:398) and *Pichia stipitis* CBS 6054 (coding SEQ ID NO:395; protein SEQ ID NO:396).

In addition, in embodiments, overexpression of the transcriptional activator genes AFT1 and/or AFT2 or homologs thereof in a recombinant yeast microorganism improves DHAD activity. Thus, the invention also provides recombinant yeast host cells comprising the isolated nucleic acid molecules of the invention, further genetically engineered to have increased heterologous or native expression of AFT1 and/or AFT2 or homologs thereof. In general, cells that overexpress AFT1 and/or AFT2 or homologs thereof exhibit enhanced DHAD activity. The observed increases in DHAD activity resulting from the increased expression of AFT1 and/or AFT2 have broad applicability to any DHAD-requiring biosynthetic pathway, as DHAD activity is often a rate-limiting component of such pathways.

Grx3, Grx4, Fra2 and Ccc1 are proteins involved in iron-sulfur cluster biosynthesis in yeast. Grx3 and Grx4 are monothiol glutaredoxins that have been shown to be involved in cellular Fe content modulation and delivery in yeast. Glutaredoxins are glutathione-dependent thiol-disulfide oxidoreductases that function in maintaining the cellular redox homeostasis. *Saccharomyces cerevisiae* has two dithiol glutaredoxins (Grx1 and Grx2) and three monothiol glutaredoxins (Grx3, Grx4, and Grx5). The monothiol glutaredoxins are believed to reduce mixed disulfides formed between a protein and glutathione in a process known as deglutathionylation. Thus, the invention is also directed to a recombinant host described herein (e.g., yeast) further genetically modified to disrupt a gene encoding an endogenous Fra2, Grx3, Grx4, and/or Ccc1 or a homolog thereof. In embodiments, increases in DHAD activity may be observed in yeast cells with disruptions in FRA2, GRX3, GRX4, and/or CCC1.

In some embodiments, the invention is also directed to a recombinant host described herein (e.g., yeast) further genetically modified to disrupt (e.g., delete) a gene encoding pyruvate decarboxylase (PDC). In some embodiments, the PDC is PDC1, PDC5, PDC6, or combinations thereof.

Bacterial Cells

In some embodiments, the recombinant host cell is a prokaryotic cell. In certain embodiments, the recombinant host cell is a bacterial cell. In other embodiments, the bacterial cell is a lactic acid bacterial (LAB) cell selected from the group consisting of *Lactococcus, Lactobacillus, Leuconostoc, Oenococcus, Pediococcus,* and *Streptococcus*. In still other embodiments, the bacterial host cell is the lactic acid bacteria *Lactobacillus*. In some embodiments, the bacterial host cell is *Lactobacillus plantarum*.

Bacterial cells that can be hosts for expression of a heterologous bacterial [2Fe-2S]$^{2+}$ DHAD include, but are not limited to, *Clostridium, Zymomonas, Escherichia, Salmonella, Rhodococcus, Pseudomonas, Bacillus, Lactobacillus, Enterococcus, Pediococcus, Alcaligenes, Klebsiella, Paenibacillus, Arthrobacter, Corynebacterium, Brevibacterium, Lactococcus, Leuconostoc, Oenococcus, Pediococcus,* and *Streptococcus*. Engineering expression of a heterologous DHAD variant can increase DHAD activity in a host bacterial cell that naturally expresses a [2Fe-2S]$^{2+}$ DHAD or a [4Fe-4S]$^{2+}$ DHAD. Such host cells can include, for example, *Escherichia coli* and *Bacillus subtilis*. Furthermore, engineering expression of a heterologous DHAD variant provides DHAD activity in a host bacterial cell that has no endogenous DHAD activity. Such host cells can include, for example, *Lactobacillus, Enterococcus, Pediococcus* and *Leuconostoc*.

Specific hosts include, for example, *Escherichia coli, Alcaligenes eutrophus, Bacillus licheniformis, Paenibacillus macerans, Rhodococcus erythropolis, Pseudomonas putida, Lactobacillus plantarum, Enterococcus faecium, Enterococcus gallinarium, Enterococcus faecalis,* and *Bacillus subtilis.* Bacterial cells can be genetically modified for expression of DHAD variants using methods well known to one skilled in the art. Expression of DHAD variants is generally achieved by transforming suitable bacterial host cells with a sequence encoding a DHAD variant protein. Typically, the coding sequence is part of a chimeric gene used for transformation, which includes a promoter operably linked to the coding sequence as well as a ribosome binding site and a termination control region. The coding region can be from the host cell for transformation and combined with regulatory sequences that are not native to the natural gene encoding the variant DHAD. Alternatively, the coding region can be from another host cell.

Vectors can be introduced into LAB host cells using methods known in the art, such as electroporation (Cruz-Rodz et al., Molecular Genetics and Genomics 224:1252-154 (1990), Bringel et al., Appl. Microbiol. Biotechnol. 33: 664-670 (1990), Alegre et al., FEMS Microbiology letters 241:73-77 (2004)), and conjugation (Shrago et al., Appl. Environ. Microbiol. 52:574-576 (1986)). A chimeric DHAD gene can also be integrated into the chromosome of LAB using integration vectors (Hols et al., Appl. Environ. Microbiol. 60:1401-1403 (1990), and Jang et al., Micro. Lett. 24:191-195 (2003)).

Lactic acid bacteria are well characterized and are used commercially in a number of industrial processes. Although it is known that some lactic acid bacteria possess iron-sulfur (Fe—S) cluster requiring enzymes (Liu et al., Journal of Biological Chemistry (2000), 275(17), 12367-12373), and therefore possess the genetic machinery to produce Fe—S clusters, little is known about the ability of lactic acid bacteria to insert Fe—S clusters into heterologous enzymes, and little is known about the facility with which Fe—S cluster forming proteins can be expressed in lactic acid bacteria.

To obtain high levels of product in a lactic acid bacterium from a biosynthetic pathway including DHAD activity, high expression of DHAD activity is desired. The activity of the Fe—S requiring DHAD enzyme in a host cell can be limited, for example, by the availability of Fe—S clusters in the cell. Increasing the expression of Fe—S cluster forming proteins effectively increased the activity of DHAD in LAB cells. Thus, in certain embodiments, a lactic acid bacterial host cell is genetically engineered to express at least one recombinant genetic expression element encoding Fe—S cluster forming proteins. The genetic engineering of lactic acid bacteria to express iron-sulfur cluster forming proteins is described in U.S. Appl. Pub. No. 2010/0081182, which is herein incorporated by reference.

Expression of any set of proteins for Fe—S cluster formation can be used to increase DHAD activity in LAB cells. There are three known groups of Fe—S cluster forming proteins. These proteins are encoded by three types of operons: the Suf operon, the Isc operon, and the Nif operon. U.S. Appl. Pub. No. 2010/0081182 discloses the Suf operons of *Lactobacillus plantarum* (*L. plantarum*), *Lactobacillus lactis* (*L. lactis*), and *Escherichia coli* (*E. coli*); the Isc operon of *E. coli*; and the Nif operon of *Wolinella succinogenes.* Additional Fe—S cluster forming proteins can be readily identified by a skilled artisan, for example, by using the sequences disclosed in U.S. Appl. Pub. No. 2010/0081182 as sequence probes to identify homologous proteins in a desired organism.

Culture Conditions for Butanol Production

The invention is also directed to a method for the production of butanol (e.g., isobutanol), comprising providing a recombinant host cell comprising the isolated nucleic acid molecules of the present invention encoding a variant DHAD described herein; culturing the recombinant host cell in a fermentation medium under suitable conditions to produce isobutanol from pyruvate; and recovering the isobutanol. In certain embodiments, the butanol (e.g., isobutanol) is produced at a titer that is increased as compared to a recombinant host cell that does not contain a variant DHAD.

In other embodiments, the isobutanol is produced at a rate that is increased by at least about 5%, at least about 10%, at least about 15%, at least about 20%, at least about 15%, at least about 30%, at least about 35%, at least about 40%, at least about 45%, or at least about 50%, or more, as compared to a recombinant host cell that does not contain a variant DHAD. In other aspects of the method to produce isobutanol, the concentration of isobutanol in the fermentation medium is greater than or equal to about 10 mM, greater than or equal to about 20 mM, greater than or equal to about 30 mM, greater than or equal to about 40 mM, greater than or equal to about 50 mM, greater than or equal to about 60 mM, greater than or equal to about 70 mM, greater than or equal to about 80 mM, greater than or equal to about 950 mM, or greater than or equal to about 100 mM.

The invention is also directed to methods for the production of butanol comprising providing a recombinant host cell comprising a polypeptide or variant thereof of the present invention, or a nucleic acid molecule which encodes a polypeptide or variant thereof of the present invention. In some embodiments, the method is a method for the production of isobutanol, comprising providing a recombinant host cell comprising a nucleic acid molecule of the invention encoding a variant DHAD, culturing the recombinant host cell in a fermentation medium under suitable conditions to produce isobutanol from pyruvate; and recovering the isobutanol. In some embodiments, the butanol (e.g., isobutanol) is produced at a titer that is increased as compared to a recombinant host cell that does not contain a variant DHAD. In other embodiments, the butanol (e.g., isobutanol) is produced at a rate that is increased by at least 5%, at least 10%, at least 15%, at least 20%, at least 25%, at least 30%, at least 35%, at least 40%, at least 45%, at least 50%, or more, as compared to a recombinant host cell that does not contain a variant DHAD, or any range of values thereof. In other embodiments, the butanol (e.g., isobutanol) is produced at a titer that is increased as compared to a recombinant host cell that does not contain a variant DHAD. In other embodiments, the butanol (e.g., isobutanol) is produced at a rate that is increased by about 5%, about 10%, about 15%, about 20%, about 25%, about 30%, about 35%, about 40%, about 45%, about 50%, or more, as compared to a recombinant host cell that does not contain a variant DHAD, or any range of values thereof. In other embodiments, the butanol (e.g., isobutanol) is produced at a rate that is increased by about 5% to about 50%, about 5% to about 45%, about 5% to about 40%, about 5% to about 35%, about 5% to about 30%, about 5% to about 25%, about 5% to about 20%, about 5% to about 15%, about 5% to about 10%, about 10% to about 50%, about 10% to about 45%, about 10% to about 40%, about 10% to about 35%, about 10% to about 30%, about 10% to about 25%, about 10% to about 20%, or about 10% to about 15%, as compared to a recombinant host cell that does not contain a variant DHAD.

In other aspects of the method to produce butanol, the concentration of butanol (e.g., isobutanol) in the fermentation medium is greater than or equal to about 10 mM, greater than or equal to about 20 mM, greater than or equal to about 30 mM, greater than or equal to about 40 mM, greater than or equal to about 50 mM, greater than or equal to about 60 mM, greater than or equal to about 70 mM, greater than or equal to about 80 mM, greater than or equal to about 90 mM, greater than or equal to about 100 mM, or more, or any range of values thereof. In some embodiments, the concentration of butanol (e.g., isobutanol) in the fermentation medium is about 10 mM to about 100 mM, about 20 mM to about 100 mM, about 30 mM to about 100 mM, about 40 mM to about 100 mM, about 50 mM to about 100 mM, about 60 mM to about 100 mM, about 70 mM to about 100 mM, about 80 mM to about 100 mM, or about 90 mM to about 100 mM.

In other embodiments, the invention is directed to a method of converting 2,3-dihydroxyisovalerate to α-ketoisovalerate or 2,3-dihydroxymethylvalerate to α-ketomethylvalerate, comprising providing a polypeptide or variant thereof of the invention. In some embodiments, the method comprises (a) providing a polypeptide or variant thereof of the invention, and (b) contacting the polypeptide or variant thereof with 2,3-dihydroxyisovalerate or 2,3-dihydroxymethylvalerate under conditions whereby 2,3-dihydroxyisovalerate is converted to α-ketoisovalerate, or whereby 2,3-dihydroxymethylvalerate is converted to α-ketomethylvalerate. It has been discovered that the activity of the polypeptides or variants of the invention is increased, and/or the conversion of 2,3-dihydroxyisovalerate to α-ketoisovalerate or 2,3-dihydroxymethylvalerate to α-ketomethylvalerate is improved, as compared to a control polypeptide having DHAD activity which does not comprise a tag.

Recombinant host cells disclosed herein are grown in media which contains suitable carbon substrates. Additional carbon substrates can include, but are not limited to, monosaccharides such as fructose, oligosaccharides such as lactose, maltose, galactose, sucrose, or mixtures thereof, polysaccharides such as starch, cellulose or mixtures thereof, and unpurified mixtures from renewable feedstocks such as cheese whey permeate, cornsteep liquor, sugar beet molasses, and barley malt. Other carbon substrates can include, but are not limited to, ethanol, lactate, succinate, glycerol, or mixtures thereof.

Additionally, in some embodiments, the carbon substrate can also be a one carbon substrate such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine, and a variety of amino acids for metabolic activity. For example, methylotrophic yeasts are known to utilize the carbon from methylamine to form trehalose or glycerol (Bellion et al., Microb. Growth C1 Compd., [Int. Symp.], 7th (1993), 415 32, Editor(s): Murrell, J. Collin; Kelly, Don P. Publisher: Intercept, Andover, UK). Similarly, various species of Candida will metabolize alanine or oleic acid (Sulter et al., Arch. Microbiol. 153:485 489 (1990)). Hence, it is contemplated that the source of carbon utilized in the present invention can encompass a wide variety of carbon containing substrates and will only be limited by the choice of organism.

Although it is contemplated that all of the above mentioned carbon substrates and mixtures thereof are suitable in the present invention, in some embodiments, the carbon substrates are glucose, fructose, and sucrose, or mixtures of these with five-carbon (C5) sugars such as xylose and/or arabinose for yeasts cells modified to use C5 sugars. Sucrose can be derived from renewable sugar sources such as sugar cane, sugar beets, cassava, sweet sorghum, and mixtures thereof. Glucose and dextrose can be derived from renewable grain sources through saccharification of starch based feedstocks including grains such as corn, wheat, rye, barley, oats, and mixtures thereof. In addition, fermentable sugars can be derived from renewable cellulosic or lignocellulosic biomass through processes of pretreatment and saccharification, as described, for example, in U.S. Pat. No. 7,932,063, which is herein incorporated by reference. Biomass refers to any cellulosic or lignocellulosic material and includes materials comprising cellulose, and optionally further comprising hemicellulose, lignin, starch, oligosaccharides and/or monosaccharides. Biomass can also comprise additional components, such as protein and/or lipid. Biomass can be derived from a single source, or biomass can comprise a mixture derived from more than one source; for example, biomass can comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs, bushes, vegetables, fruits, flowers, animal manure, and mixtures thereof.

In addition to an appropriate carbon source, fermentation media contains suitable minerals, salts, cofactors, buffers and other components, known to those skilled in the art and suitable for growth of the cultures and promotion of an enzymatic pathway comprising a DHAD.

Typically, cells are grown at a temperature in the range of about 20° C. to about 40° C. in an appropriate medium. Suitable growth media for the present invention include, for example, common commercially prepared media such as Luria Bertani (LB) broth, Sabouraud Dextrose (SD) broth, Yeast Medium (YM) broth, or broth that includes yeast nitrogen base, ammonium sulfite, and dextrose (as the carbon/energy source) or Yeast Extract Peptone Dextrose (YPD) Medium, a blend of peptone, yeast extract, and dextrose in optimal proportions for growing most Saccharomyces cerevisiae strains. Other defined or synthetic growth media can also be used, and the appropriate medium for growth of the particular microorganism will be known by one skilled in the art of microbiology or fermentation science. The use of agents known to modulate catabolite repression directly or indirectly, e.g., cyclic adenosine 2':3' monophosphate, can also be incorporated into the fermentation medium.

Suitable pH ranges for the fermentation are from about pH 5.0 to about pH 9.0, In one embodiment, about pH 6.0 to about pH 8.0 is used for the initial condition. Suitable pH ranges for the fermentation of yeast are typically between about pH 3.0 to about pH 9.0. In one embodiment, about pH 5.0 to about pH 8.0 is used for the initial condition. Suitable pH ranges for the fermentation of other microorganisms are from about pH 3.0 to about pH 7.5. In one embodiment, about pH 4.5 to about pH 6.5 is used for the initial condition.

Fermentations can be performed under aerobic or anaerobic conditions. In one embodiment, anaerobic or microaerobic conditions are used for fermentations.

Industrial Batch and Continuous Fermentations

Isobutanol, or other products, can be produced using a batch method of fermentation. A classical batch fermentation is a closed system where the composition of the medium is set at the beginning of the fermentation and not subject to artificial alterations during the fermentation. A variation on the standard batch system is the fed batch system. Fed batch fermentation processes are also suitable in the present invention and comprise a typical batch system with the exception that the substrate is added in increments as the fermentation progresses. Fed batch systems are useful when catabolite repression is apt to inhibit the metabolism of the cells and where it is desirable to have limited amounts of substrate in the media. Batch and fed batch fermentations are common and well known in the art, examples of which are found in Thomas D. Brock in Biotechnology: A Textbook of Industrial Microbiology, Second Edition (1989) Sinauer Associates, Inc., Sunderland, M.A., or Deshpande, Mukund V., Appl. Biochem. Biotechnol., 36:227, (1992), herein incorporated by reference.

Isobutanol, or other products, can also be produced using continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other products, can be practiced using batch, fed batch or continuous processes and that any known mode of fermentation is suitable. Additionally, it is contemplated that cells can be immobilized on a substrate as whole cell catalysts and subjected to fermentation conditions for isobutanol production.

Biosynthetic Pathways

Expression of a DHAD variant in bacteria or yeast, as described herein, provides the transformed, recombinant host cell with dihydroxy-acid dehydratase (DHAD) activity for conversion of 2,3-dihydroxyisovalerate to α-ketoisovalerate or 2,3-dihydroxymethylvalerate to α-ketomethylvalerate. Any product that has α-ketoisovalerate or α-ketomethylvalerate as a pathway intermediate can be produced in a bacterial or yeast strain disclosed herein having the described heterologous DHAD variants. A list of such products includes, but is not limited to, valine, isoleucine, leucine, pantothenic acid, 2-methyl-1-butanol, 3-methyl-1-butanol and isobutanol.

For example, yeast biosynthesis of valine includes steps of acetolactate conversion to 2,3-dihydroxyisovalerate by acetohydroxyacid reductoisomerase (ILV5), conversion of 2,3-dihydroxyisovalerate to α-ketoisovalerate (also called 2-keto-isovalerate) by dihydroxy-acid dehydratase, and conversion of α-ketoisovalerate to valine by branched-chain amino acid transaminase (BAT2) and branched-chain amino acid aminotransferase (BAT1). Biosynthesis of leucine includes the same steps to α-ketoisovalerate, followed by conversion of α-ketoisovalerate to α-isopropylmalate by α-isopropylmalate synthase (LEU9, LEU4), conversion of α-isopropylmalate to beta-isopropylmalate by isopropylmalate isomerase (LEU1), conversion of beta-isopropylmalate to α-ketoisocaproate by beta-IPM dehydrogenase (LEU2), and finally conversion of α-ketoisocaproate to leucine by branched-chain amino acid transaminase (BAT2) and branched-chain amino acid aminotransferase (BAT1). The bacterial pathway is similar, involving differently named proteins and genes. Increased conversion of 2,3-dihydroxyisovalerate to α-ketoisovalerate will increase flow in these pathways, particularly if one or more additional enzymes of a pathway is overexpressed. Thus, it is desired for production of valine or leucine to use a strain disclosed herein.

Biosynthesis of pantothenic acid includes a step performed by DHAD, as well as steps performed by ketopantoate hydroxymethyltransferase and pantothenate synthase. Engineering of expression of these enzymes for enhanced production of pantothenic acid biosynthesis in microorganisms is described, for example, in U.S. Pat. No. 6,177,264, which is incorporated by reference herein.

The α-ketoisovalerate product of DHAD is an intermediate in the isobutanol biosynthetic pathways disclosed, for example, in U.S. Pat. No. 7,851,188, which is incorporated by reference herein. A diagram of the disclosed isobutanol biosynthetic pathways is provided in FIG. 1. Production of isobutanol in a strain disclosed herein benefits from increased DHAD activity. As disclosed herein, DHAD activity is provided by expression of a variant DHAD in a bacterial or yeast cell. As described in U.S. Pat. No. 7,851,188, steps in an example isobutanol biosynthetic pathway include conversion of: pyruvate to acetolactate as catalyzed for example by acetolactate synthase, acetolactate to 2,3-dihydroxyisovalerate as catalyzed for example by acetohydroxy acid isomeroreductase; 2,3-dihydroxyisovalerate to α-ketoisovalerate as catalyzed for example by acetohydroxy acid dehydratase, also called dihydroxy-acid dehydratase (DHAD); α-ketoisovalerate to isobutyraldehyde as catalyzed for example by branched-chain α-keto acid decarboxylase; and isobutyraldehyde to isobutanol as catalyzed for example by branched-chain alcohol dehydrogenase. The substrate to product conversions, and enzymes involved in these reactions, are described, for example, in U.S. Pat. No. 7,851,188, which is incorporated by reference herein.

Genes that can be used for expression of the pathway step enzymes named above other than the variant DHADs disclosed herein, as well as those for two additional isobutanol pathways, are described, for example, in U.S. Pat. No. 7,851,188, which is incorporated by reference herein. Additional genes that can be used can be identified by one skilled in the art through bioinformatics or experimentally as described above. Ketol-acid reductoisomerase (KARI) enzymes are also disclosed, for example, in U.S. Pat. No. 7,910,342 and PCT App. Pub. No. WO2012/129555, which are incorporated by reference herein. Examples of KARIs disclosed therein include KARIs from *Vibrio cholerae* (DNA: SEQ ID NO:684; protein SEQ ID NO:685), *Pseudomonas aeruginosa* PAO1, (DNA: SEQ ID NO:686; protein SEQ ID NO:687), *Pseudomonas fluorescens* PF5 (DNA: SEQ ID NO:688; protein SEQ ID NO:689) and *Anaerostipes caccae* (protein SEQ ID NO:697).

Additionally described in U.S. Pat. No. 7,851,188 is the construction of chimeric genes and genetic engineering of bacteria and yeast for isobutanol production using the disclosed biosynthetic pathways. In some embodiments, one or more components of the above-described biosynthetic pathways can be endogenous to the host cell of choice, or can be heterologous. Additionally, in other embodiments, one or more of the genes encoding the enzymes required in the above-described biosynthetic pathways can be overexpressed in the host cell.

Methods for Butanol Isolation from Fermentation Medium

Bioproduced butanol (e.g., isobutanol) may be isolated from the fermentation medium using methods known in the art for ABE fermentations (see, e.g., Durre, Appl. Microbiol. Biotechnol. 49:639-648 (1998), Groot et at, Process. Biochem. 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, or pervaporation.

Because isobutanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see, e.g., Doherty and Malone, *Conceptual Design of Distillation Systems*, McGraw Hill, New York, 2001).

The butanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The isobutanol can also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the butanol from the solvent.

Distillation in combination with adsorption can also be used to isolate isobutanol from the fermentation medium. In this method, the fermentation broth containing the isobutanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., J. Membr. Sci. 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, the alcohol can be formed by contacting the alcohol in a fermentation medium with an organic acid (e.g., fatty acids) and a catalyst capable of esterifying the alcohol with the organic acid. In such embodiments, the organic acid can serve as an ISPR extractant into which the alcohol esters partition. The organic acid can be supplied to the fermentation vessel and/or derived from the biomass supplying fermentable carbon fed to the fermentation vessel. Lipids present in the feedstock can be catalytically hydrolyzed to organic acid, and the same catalyst (e.g., enzymes) can esterify the organic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into organic acid and substantially simultaneous esterification of the organic acid with butanol present in the fermentation vessel. Organic acid and/or native oil not derived from the feedstock can also be fed to the fermentation vessel, with the native oil being hydrolyzed into organic acid. Any organic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester reduces the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to organic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the organic acid extractant can contact the fermentation medium at a time before the butanol concentration reaches a toxic level, so as to esterify the butanol with the organic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

EXAMPLES

Example 1

Construction of Yeast Strain PNY2115, PNY2145 and Other Plasmids Creation of PNY2115

Yeast strain PNY2115 has the following genotype: MATa ura3Δ::loxP his3Δ pdc5Δ::loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66.

Saccharomyces cerevisiae strain PNY0827 is used as the starting strain for the construction of strain PNY2115. PNY0827 refers to a strain derived from Saccharomyces cerevisiae which has been deposited at the ATCC under the Budapest Treaty on Sep. 22, 2011 at the American Type Culture Collection, Patent Depository 10801 University Boulevard, Manassas, Va. 20110-2209 and has the patent deposit designation PTA-12105.

1. Deletion of URA3 and Sporulation into Haploids

In order to delete the endogenous URA3 coding region, a deletion cassette was

PCR-amplified from pLA54 (SEQ ID NO:592) which contains a PTEF1-kanMX4-TEF1t cassette flanked by loxP sites to allow homologous recombination in vivo and subsequent removal of the KANMX4 marker. PCR was done by using Phusion High Fidelity PCR Master Mix (New England BioLabs; Ipswich, Mass.) and primers BK505 (SEQ ID NO:593) and BK506 (SEQ ID NO:594). The URA3 portion of each primer was derived from the 5' region 180 nucleotides upstream of the URA3 ATG and 3' region 78 nucleotides downstream of the coding region such that integration of the kanMX4 cassette results in replacement of the URA3 coding region. The PCR product was transformed into PNY0827 using standard genetic techniques (Methods in Yeast Genetics, 2005, Cold Spring Harbor Laboratory Press, Cold Spring Harbor, N.Y., pp. 201-202) and transformants were selected on Yeast Extract Peptone (YEP) medium supplemented with 2% glucose and 100 µg/ml Geneticin® (Invitrogen Life Technologies™, Grand Island, N.Y.) at 30° C. Transformants were screened by colony PCR with primers LA468 (SEQ ID NO:595) and LA492 (SEQ ID NO:596) to verify presence of the integration cassette. A heterozygous diploid was obtained: NYLA98, which has the genotype MATa/α URA3/ura3::loxP-kanMX4-loxP. To obtain haploids, NYLA98 was sporulated using standard methods (Codón A. C., Gasent-Ramírez J. M., Benítez T. Factors which affect the frequency of sporulation and tetrad formation in Saccharomyces cerevisiae baker's yeast. Appl Environ Microbiol. 1995 PMID: 7574601). Tetrads were dissected using a micromanipulator and grown on rich YEP medium supplemented with 2% glucose. Tetrads containing four viable spores were patched onto synthetic complete medium lacking uracil supplemented with 2% glucose, and the mating type was verified by multiplex colony PCR using primers AK109-1 (SEQ ID NO:597), AK109-2 (SEQ ID NO:598), and AK109-3 (SEQ ID NO:599). The resulting identified haploid strain was called NYLA103, which has the genotype: MATa ura3Δ::loxP-kanMX4-loxP, and NYLA106, which has the genotype: MATa ura3Δ::loxP-kanMX4-loxP.

2. Deletion of HIS3

To delete the endogenous HIS3 coding region, a scarless deletion cassette was used. The four fragments for the PCR cassette for the scarless HIS3 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen Inc., Valencia, Calif.). HIS3 Fragment A was amplified with primer oBP452 (SEQ ID NO:600) and primer oBP453 (SEQ ID NO:601), containing a 5' tail with homology to the 5' end of HIS3 Fragment B. HIS3 Fragment B was amplified with primer oBP4S4 (SEQ ID NO:602), containing a 5' tail with homology to the 3' end of HIS3 Fragment A, and primer oBP455 (SEQ ID NO:603) containing a 5' tail with homology to the 5' end of HIS3 Fragment U. HIS3 Fragment U was amplified with primer oBP456 (SEQ ID NO:604), containing a 5' tail with homology to the 3' end of HIS3 Fragment B, and primer oBP457 (SEQ ID NO:605), containing a 5' tail with homology to the 5' end of HIS3 Fragment C. HIS3 Fragment C was amplified with primer oBP458 (SEQ ID NO:606), containing a 5' tail with homology to the 3' end of HIS3 Fragment U, and primer oBP459 (SEQ ID NO:607). PCR products were purified with a PCR Purification kit (Qiagen Inc., Valencia, Calif.). HIS3 Fragment AB was created by overlapping PCR by mixing HIS3 Fragment A and HIS3 Fragment B and amplifying with primers oBP452 (SEQ ID NO:600) and oBP455 (SEQ ID NO:603). HIS3 Fragment UC was created by overlapping PCR by mixing HIS3 Fragment U and HIS3 Fragment C and amplifying with primers oBP456 (SEQ ID NO:604) and oBP459 (SEQ ID NO:607). The resulting PCR products were purified on an agarose gel followed by a Gel Extraction kit (Qiagen Inc., Valencia, Calif.). The HIS3 ABUC cassette was created by overlapping PCR by mixing HIS3 Fragment AB and HIS3 Fragment UC and amplifying with primers oBP452 (SEQ ID NO:600) and oBP459 (SEQ ID NO:607). The PCR product was purified with a PCR Purification kit (Qiagen Inc., Valencia, Calif.). Competent cells of NYLA106 were transformed with the HIS3 ABUC PCR cassette and were plated on synthetic complete medium lacking uracil supplemented with 2% glucose at 30° C. Transformants were screened to verify correct integration by replica plating onto synthetic complete medium lacking histidine and supplemented with 2% glucose at 30° C. Genomic DNA preparations were made to verify the integration by PCR using primers oBP460 (SEQ ID NO:608) and LA135 (SEQ ID NO:609) for the 5' end and primers oBP461 (SEQ ID NO:610) and LA92 (SEQ ID NO:611) for the 3' end. The URA3 marker was recycled by plating on synthetic complete medium supplemented with 2% glucose and 5-fluoroorotic acid (5-FOA) at 30° C. following standard protocols. Marker removal was confirmed by patching colonies from 5-fluoroorotic Acid (5-FOA) plates onto SD-URA medium to verify the absence of growth. The resulting identified strain, called PNY2003 has the genotype: MATa ura3Δ::loxP-kanMX4-loxP his3Δ.

3. Deletion of PDC 1

To delete the endogenous PDC1 coding region, a deletion cassette was PCR-amplified from pLA59 (SEQ ID NO:612), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA678 (SEQ ID NO:613) and LA679 (SEQ ID NO:614). The PDC1 portion of each primer was derived from the 5' region 50 nucleotides downstream of the PDC1 start codon and 3' region 50 nucleotides upstream of the stop codon such that integration of the URA3 cassette results in replacement of the PDC1 coding region but leaves the first 50 nucleotides and the last 50 nucleotides of the coding region. The PCR product was transformed into PNY2003 using standard genetic techniques and transformants were selected on synthetic complete medium lacking uracil and supplemented with 2% glucose at 30° C. Transformants were screened to verify correct integration by colony PCR using primers LA337 (SEQ ID NO:615), external to the 5' coding region and LA135 (SEQ ID NO:609), an internal primer to URA3. Positive transformants were then screened by colony PCR using primers LA692 (SEQ ID NO:616) and LA693 (SEQ ID NO:617), internal to the PDC1 coding region. The URA3 marker was recycled by transforming with pLA34 (SEQ ID NO:618) containing the CRE recombinase under the GAL1 promoter and plated on synthetic complete medium lacking histidine and supplemented with 2% glucose at 30° C. Transformants were plated on rich medium supplemented with 0.5% galactose to induce the recombinase. Marker removal was confirmed by patching colonies to synthetic complete medium lacking uracil and supplemented with 2% glucose to verify absence of growth. The resulting identified strain, called PNY2008 has the genotype: MATa ura3Δ:: loxP-kanMX4-loxP his3Δ pdc1Δ::loxP71/66.

4. Deletion of PDC5

To delete the endogenous PDC5 coding region, a deletion cassette was PCR-amplified from pLA59 (SEQ ID NO:612), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA722 (SEQ ID NO:619) and LA733 (SEQ ID NO:620). The PDC5 portion of each primer was derived from the 5' region 50 nucleotides upstream of the PDC5 start codon and 3' region 50 nucleotides downstream of the stop codon such that integration of the URA3 cassette results in replacement of the entire PDC5 coding region. The PCR product was transformed into PNY2008 using standard genetic techniques and transformants were selected on synthetic complete medium lacking uracil and supplemented with 1% ethanol at 30° C. Transformants were screened to verify correct integration by colony PCR using primers LA453 (SEQ ID NO:621), external to the 5' coding region and LA135 (SEQ ID NO:609), an internal primer to URA3. Positive transformants were then screened by colony PCR using primers LA694 (SEQ ID NO:622) and LA695 (SEQ ID NO:623), internal to the PDC5 coding region. The URA3 marker was recycled by transforming with pLA34 (SEQ ID NO:618) containing the CRE recombinase under the GAL1 promoter and plated on synthetic complete medium lacking histidine and supplemented with 1% ethanol at 30° C. Transformants were plated on rich YEP medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2009 has the genotype: MATa ura3Δ::loxP-kanMX4-loxP his3Δ pdc1Δ::loxP71/66 pdc5Δ::loxP71/66.

5. Deletion of FRA2

The FRA2 deletion was designed to delete 250 nucleotides from the 3' end of the coding sequence, leaving the first 113 nucleotides of the FRA2 coding sequence intact. An in-frame stop codon was present seven nucleotides downstream of the deletion. The four fragments for the PCR cassette for the scarless FRA2 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen Inc., Valencia, Calif.). FRA2 Fragment A was amplified with primer oBP594 (SEQ ID NO:624) and primer oBP595 (SEQ ID NO:625), containing a 5' tail with homology to the 5' end of FRA2 Fragment B. FRA2 Fragment B was amplified with primer oBP596 (SEQ ID NO:626), containing a 5' tail with homology to the 3' end of FRA2 Fragment A, and primer oBP597 (SEQ ID NO:627), containing a 5' tail with homology to the 5' end of FRA2 Fragment U. FRA2 Fragment U was amplified with primer oBP598 (SEQ ID NO:628), containing a 5' tail with homology to the 3' end of FRA2 Fragment B, and primer oBP599 (SEQ ID NO:629), containing a 5' tail with homology to the 5' end of FRA2 Fragment C. FRA2 Fragment C was amplified with primer oBP600 (SEQ ID NO:630), containing a 5' tail with homology to the 3' end of FRA2 Fragment U, and primer oBP601 (SEQ ID NO:631). PCR products were purified with a PCR Purification kit (Qiagen Inc., Valencia, Calif.). FRA2 Fragment AB was created by overlapping PCR by mixing FRA2 Fragment A and FRA2 Fragment B and amplifying with primers oBP594 (SEQ ID NO:624) and oBP597 (SEQ ID NO:627). FRA2 Fragment UC was created by overlapping PCR by mixing FRA2 Fragment U and FRA2 Fragment C and amplifying with primers oBP598 (SEQ ID NO:628) and oBP601 (SEQ ID NO:631). The resulting PCR products were purified on an agarose gel followed by a Gel Extraction kit (Qiagen Inc., Valencia, Calif.). The FRA2 ABUC cassette was created by overlapping PCR by mixing FRA2 Fragment AB and FRA2 Fragment UC and amplifying with primers oBP594 (SEQ ID NO:624) and oBP601 (SEQ ID NO:631). The PCR product was purified with a PCR Purification kit (Qiagen Inc., Valencia, Calif.).

To delete the endogenous FRA2 coding region, the scarless deletion cassette obtained above was transformed into PNY2009 using standard techniques and plated on synthetic complete medium lacking uracil and supplemented with 1% ethanol. Genomic DNA preparations were made to verify the integration by PCR using primers oBP602 (SEQ ID NO:632) and LA135 (SEQ ID NO:609) for the 5' end, and primers oBP602 (SEQ ID NO:632) and oBP603 (SEQ ID NO:633) to amplify the whole locus. The URA3 marker was recycled by plating on synthetic complete medium supplemented with 1% ethanol and 5-FOA at 30° C. following standard protocols. Marker removal was confirmed by patching colonies from the 5-FOA plates onto synthetic complete medium lacking uracil and supplemented with 1% ethanol to verify the absence of growth. The resulting identified strain, PNY2037, has the genotype: MATa ura3Δ::loxP-kanMX4-loxP his3Δ pdc1Δ::loxP71/66 pdc5Δ::loxP71/66 fra2Δ.

6. Addition of Native 2 Micron Plasmid

The loxP71-URA3-loxP66 marker was PCR-amplified using Phusion DNA polymerase (New England BioLabs; Ipswich, Mass.) from pLA59 (SEQ ID NO:612), and transformed along with the LA811x817 (SEQ ID NOs:634 and 635) and LA812x818 (SEQ ID NOs:636 and 637) 2-micron plasmid fragments (amplified from the native 2-micron plasmid from CEN.PK 113-7D; Centraalbureau voor Schimmelcultures (CBS) Fungal Biodiversity Centre) into strain PNY2037 on SE-URA plates at 30° C. The resulting strain PNY2037 2μ::loxP71-URA3-loxP66 was transformed with pLA34 (pRS423::cre) (also called, pLA34) (SEQ ID NO:618) and selected on SE-HIS-URA plates at 30° C. Transformants were patched onto YP-1% galactose plates and allowed to grow for 48 hrs at 30° C. to induce Cre recombinase expression. Individual colonies were then patched onto SE-URA, SE-HIS, and YPE plates to confirm URA3 marker removal. The resulting identified strain, PNY2050, has the genotype: MATa ura3Δ::loxP-kanMX4-loxP, his3Δ pdc1Δ::loxP71/66 pdc5Δ::loxP71/66 fra2Δ 2-micron.

7. Construction of PNY2115 from PNY2050

Construction of PNY2115 [MATa ura3Δ::loxP his3Δ pdc5Δ::loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66] from PNY2050 was as follows:

a. pdc1Δ::P[PDC1]-ALS|alsS_Bs-CYC1t-loxP71/66

To integrate alsS into the pdc1Δ::loxP66/71 locus of PNY2050 using the endogenous PDC1 promoter, an integration cassette was PCR-amplified from pLA71 (SEQ ID NO:643), which contains the gene acetolactate synthase from the species *Bacillus subtilis* with a FBA1 promoter and a CYC1 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 895 (SEQ ID NO:663) and 679 (SEQ ID NO:664). The PDC1 portion of each primer was derived from 60 nucleotides of the upstream of the coding sequence and 50 nucleotides that are 53 nucleotides upstream of the stop codon. The PCR product was transformed into PNY2050 using standard genetic techniques and transformants were selected on synthetic complete media lacking uracil and supplemented with % ethanol at 30° C. Transformants were screened to verify correct integration by colony PCR using primers 681 (SEQ ID NO:665), external to the 3' coding region and 92 (SEQ ID NO:666), internal to the URA3 gene. Positive transformants were then prepped for genomic DNA and screened by PCR using primers N245 (SEQ ID NO:667) and N246 (SEQ ID NO:668). The URA3 marker was recycled by transforming with pLA34 (SEQ ID NO:618) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2090 has the genotype MATa ura3Δ::loxP, his3Δ, pdc1Δ::loxP71/66, pdc5Δ::loxP71/66 fra2Δ 2-micron pdc1Δ::P[PDC1]-ALS|alsS_Bs-CYC1t-loxP71/66.

b. pdc6Δ::(UAS)PGK1-P[FBA1]-KIVD|Lg(y)-TDH3t-loxP71/66

To delete the endogenous PDC6 coding region, an integration cassette was PCR-amplified from pLA78 (SEQ ID NO:648), which contains the kivD gene from the species *Listeria grayi* with a hybrid FBA1 promoter and a TDH3 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 896 (SEQ ID NO:669) and 897 (SEQ ID NO:670). The PDC6 portion of each primer was derived from 60 nucleotides upstream of the coding sequence and 59 nucleotides downstream of the coding region. The PCR product was transformed into PNY2090 using standard genetic techniques and transformants were selected on synthetic complete media lacking uracil and supplemented with 1% ethanol at 30° C. Transformants were screened to verify correct integration by colony PCR using primers 365 (SEQ ID NO:671) and 366 (SEQ ID NO:672), internal primers to the PDC6 gene. Transformants with an absence of product were then screened by colony PCR N638 (SEQ ID NO:673), external to the 5' end of the gene, and 740 (SEQ ID NO:674), internal to the FBA1 promoter. Genomic DNA was prepared from positive transformants and screened by PCR with two external primers to the PDC6 coding sequence. Positive integrants would yield a 4720 nucleotide long product, while PDC6 wild type transformants would yield a 2130 nucleotide long product. The URA3 marker was recycled by transforming with pLA34 containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain is called PNY2093 and has the genotype MATa ura3Δ::loxP his3Δ pdc5Δ::loxP71/66 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66.

c. adh1Δ::P[ADH1]-ADH|Bi(y)-ADHt-loxP71/66

To delete the endogenous ADH1 coding region and integrate BiADH using the endogenous ADH1 promoter, an integration cassette was PCR-amplified from pLA65 (SEQ ID NO:654), which contains the alcohol dehydrogenase from the species *Beijerinckii indica* with an ILV5 promoter and a ADH1 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 856 (SEQ ID NO:675) and 857 (SEQ ID NO:676). The ADH1 portion of each primer was derived from the 5' region 50 nucleotides upstream of the ADH1 start codon and the last 50 nucleotides of the coding region. The PCR product was transformed into PNY2093 using standard genetic techniques and transformants were selected on synthetic complete media lacking uracil and supplemented with 1% ethanol at 30° C. Transformants were screened to verify correct integration by colony PCR using primers BK415 (SEQ ID NO:677), external to the 5' coding region and N1092 (SEQ ID NO:678), internal to the BiADH gene. Positive transformants were then screened by colony PCR using primers 413 (SEQ ID NO:679), external to the 3' coding region, and 92 (SEQ ID NO:666), internal to the URA3 marker. The URA3 marker was recycled by transforming with pLA34 (SEQ ID NO:618) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2101 has the genotype MATa ura3Δ::loxP his3Δ pdc5Δ::loxP71/66 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66.

d. fra2Δ::P[ILV5]-ADH|Bi(y)-ADHt-loxP71/66

To integrate BiADH into the fra2Δ locus of PNY2101, an integration cassette was PCR-amplified from pLA65 (SEQ ID NO:654), which contains the alcohol dehydrogenase from the species *Beijerinckii indica* with an ILV5 promoter and an ADH1 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 906 (SEQ ID NO:680) and 907 (SEQ ID NO:681). The FRA2 portion of each primer was derived from the first 60 nucleotides of the coding sequence starting at the ATG and 56 nucleotides downstream of the stop codon. The PCR product was transformed into PNY2101 using standard genetic techniques and transformants were selected on synthetic complete media lacking uracil and supplemented with 1% ethanol at 30° C. Transformants were screened to verify correct integration by colony PCR using primers 667 (SEQ ID NO:682), external to the 5' coding region and 749 (SEQ ID NO:683), internal to the ILV5 promoter. The URA3 marker was recycled by transforming with pLA34 (SEQ ID NO:618) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2110 has the genotype MATa ura3Δ::loxP his3Δ pdc5Δ::loxP66/71 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66.

e. GPD2 Deletion

To delete the endogenous GPD2 coding region, a deletion cassette was PCR amplified from pLA59 (SEQ ID NO:612), which contains a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers LA512 (SEQ ID NO:638) and LA513 (SEQ ID NO:639). The GPD2 portion of each primer was derived from the 5' region 50 nucleotides upstream of the GPD2 start codon and 3' region 50 nucleotides downstream of the stop codon such that integration of the URA3 cassette results in replacement of the entire GPD2 coding region. The PCR product was transformed into PNY2110 using standard genetic techniques and transformants were selected on synthetic complete medium lacking uracil and supplemented with 1% ethanol at 30° C. Transformants were screened to verify correct integration by colony PCR using primers LA516 (SEQ ID NO:640) external to the 5' coding region and LA135 (SEQ ID NO:609), internal to URA3. Positive transformants were then screened by colony PCR using primers LA514 (SEQ ID NO:641) and LA515 (SEQ ID NO:642), internal to the GPD2 coding region. The URA3 marker was recycled by transforming with pLA34 (SEQ ID NO:618) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2115, has the genotype MATa ura3Δ::loxP his3Δ pdc5Δ::loxP66/71 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66.

pLH689

Plasmid pLH689 (SEQ ID NO:698) is a yeast-*E. coli* shuttle vector based on pHR81 (ATCC#87541). It contains genes for the expression of KARI variant K9JB4P (SEQ ID NO:697) and *S. mutans* DHAD with a C-terminal tag (SEQ ID NO:721). The positions of the relevant gene features are listed below in Table 7.

TABLE 7

Nucleotide positions of pathway gene features of plasmid pLH689 (SEQ ID NO: 698)

| Element | Description | Start | End | Strand |
|---|---|---|---|---|
| promoter | ILV5p | 427 | 1620 | T |
| CDS | K9JB4P | 1628 | 2659 | T |
| terminator | ILV5t | 2685 | 3307 | T |
| terminator | FBAt | 3320 | 3632 | B |
| CDS | *S. mutans* ilvD-lum | 3641 | 5377 | B |
| promoter | TEF1(M7)p | 5387 | 5787 | B | pLH691

Plasmid pLH691 (SEQ ID NO:590) is a yeast-*E. coli* shuttle vector based on pHR81 (ATCC#87541). It contains genes for the expression of KARI variant K9JB4P and *S. mutans* DHAD with a 9 amino acid (Δ9) deletion. The positions of the relevant gene features are listed in the Table 8.

TABLE 8

Nucleotide positions of pathway gene features
of plasmid pLH691 (SEQ ID NO: 590)

| Element | Description | Start | End | Strand |
|---|---|---|---|---|
| promoter | ILV5p | 427 | 1620 | T |
| CDS | K9JB4P | 1628 | 2659 | T |
| terminator | ILV5t | 2685 | 3307 | T |
| terminator | FBAt | 3320 | 3632 | B |
| CDS | S. mutans ilvD-Δ9 | 3644 | 5335 | B |
| promoter | TEF1(M7)p | 5339 | 5739 | B | pLH804

Plasmid pLH804 (SEQ ID NO:591) is a yeast-E. coli shuttle vector based on pHR81 (ATCC#87541). It contains genes for the expression of KARI variant K9JB4P and S. mutans DHAD. The positions of the relevant gene features are listed in the Table 9.

TABLE 9

Nucleotide positions of pathway gene features
of plasmid pLH804 (SEQ ID NO: 591)

| Element | Description | Start | End | Strand |
|---|---|---|---|---|
| promoter | ILV5p | 427 | 1620 | T |
| CDS | K9JB4P | 1628 | 2659 | T |
| terminator | ILV5t | 2685 | 3307 | T |
| terminator | FBAt | 3320 | 3632 | B |
| CDS | S. mutans ilvD | 3641 | 5356 | B |
| promoter | TEF1(M7)p | 5366 | 5766 | B | pRS413::BiADH-kivD

Plasmid pRS413::BiADH-kivD (SEQ ID NO:874) is a yeast-E. coli shuttle vector based on pRS413 (ATCC#87518), It contains genes for the expression of BiADH and kivD. The positions of the relevant gene features are listed in the Table 10.

TABLE 10

Nucleotide positions of pathway gene features
in plasmid pRS413::BiADH- kivD (SEQ ID NO: 874)

| Element | Description | Start | End | Strand |
|---|---|---|---|---|
| Promoter | FBA1p | 2293 | 2893 | T |
| CDS | kivD_Lg(y) | 2902 | 4548 | T |
| Terminator | TDH3t | 4560 | 5139 | T |
| Promoter | PDC1p | 5983 | 6852 | T |
| CDS | adhBiy | 6853 | 7896 | T |
| Terminator | ADH1t | 7905 | 8220 | T |

Creation of PNY2145

PNY2145 was constructed from PNY2115 (MATa ura3Δ::loxP his3Δ pdc5Δ::loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66; described in, for example, U.S. Provisional Appl. No. 61/842,817, filed Jul. 3, 2013, which is incorporated by reference herein) by the additional integration of a phosphoketolase gene cassette at the pdc5Δ locus and by replacing the native AMN1 gene with a codon optimized version of the ortholog from CEN.PK. Integration constructs are further described below.

pdc5Δ::FBA(L8)-xpk1-CYC1t-loxP97/66

The TEF(M4)-xpk1-CYC1t gene from pRS423::TEF(M4)-xpk1+ENO1-eutD (SEQ ID NO:829) was PCR amplified using primers N1341 and N1338 (SEQ ID NOs: 830 and 831), generating a 3.1 kb product. The loxP-flanked URA3 gene cassette from pLA59 (SEQ ID NO:832) was amplified with primers N1033c and N1342 (SEQ ID NOs: 833 and 834), generating a 1.6 kb product. The xpk1 and URA3 PCR products were fused by combining them without primers for an additional 10 cycles of PCR using Phusion DNA polymerase. The resulting reaction mix was then used as a template for a PCR reaction with KAPA Hi Fi and primers N1342 and N1364 (SEQ ID NOs:834 and 835). A 4.2 kb PCR product was recovered by purification from an electrophoresis agarose gel (Zymo kit). FBA promoter variant L8 (SEQ ID NO:836) was amplified using primers N1366 and N1368 (SEQ ID NOs:837 and 838). The xpk1::URA3 PCR product was combined with the FBA promoter by additional rounds of PCR. The resulting product was phosphorylated with polynucleotide kinase and ligated into pBR322 that had been digested with EcoRV and treated with calf intestinal phosphatase. The ligation reaction was transformed into E. coli cells (Stbl3 competent cells from Invitrogen). The integration cassette was confirmed by sequencing. To prepare DNA for integration, the plasmid was used as a template in a PCR reaction with Kapa HiFi and primers N1371 and N1372 (SEQ ID NOs:839 and 840). The PCR product was isolated by phenol-chloroform extraction and ethanol precipitation (using standard methods; e.g., Maniatas et al.). Five micrograms of DNA were used to transform strain PNY2115. Transformants were selected on medium lacking uracil (synthetic complete medium minus uracil with 1% ethanol as the carbon source). Colonies were screened for the integration event using PCR (JumpStart) with primers BK93 and N1114 (SEQ ID NOs:841 and 842). Two clones were selected to carry forward. The URA3 marker was recycled by transforming with pJT254 (SEQ ID NO:843) containing the CRE recombinase under the GAL1 promoter and plating on synthetic complete medium lacking histidine and supplemented with 1% ethanol at 30° C. Transformants were grown in rich medium supplemented with 1% ethanol to derepress the recombinase. Marker removal was confirmed for single colony isolates by patching to synthetic complete medium lacking uracil and supplemented with 1% ethanol to verify absence of growth. Loss of the recombinase plasmid, pJT254, was confirmed by patching the colonies to synthetic complete medium lacking histidine and supplemented with 1% ethanol. Proper marker removal was confirmed by PCR (primers N160SeqF5 (SEQ ID NO:844) and BK380). One resulting clone was designated PNY2293.

amn1Δ::AMN1(y)-loxP71/66

To replace the endogenous copy of AMN1 with a codon-optimized version of the AMN1 gene from CEN.PK2, an integration cassette containing the CEN.PK AMN1 promoter, AMN1(y) gene (nucleic acid SEQ ID NO:845; amino acid SEQ ID NO:846), and CEN.PK AMN1 terminator was assembled by SOE PCR and subcloned into the shuttle vector pLA59. The AMN1(y) gene was ordered from DNA 2.0 with codon-optimization for S. cerevisiae. The completed pLA67 plasmid (SEQ ID NO:847) contained: 1) pUC19 vector backbone sequence containing an E. coli replication origin and ampicillin resistance gene; 2) URA3 selection marker flanked by loxP71 and loxP66 sites; and 3) $P_{AMN1(CEN.PK)}$-AMN1(y)-term$_{AMN1(CEN.PK)}$ expression cassette.

PCR amplification of the AMN1(y)-loxP71-URA3-loxP66 cassette was done by using KAPA HiFi from Kapa Biosystems, Woburn, Mass. and primers LA712 (SEQ ID NO:848) and LA746 (SEQ ID NO:849). The PCR product was transformed into PNY2293 using standard genetic techniques and transformants were selected on synthetic complete medium lacking uracil and supplemented with 1% ethanol at 30° C. Transformants were observed under magnification for the absence of a clumping phenotype with respect to the control (PNY2293). The URA3 marker was recycled using the pJT254 Cre recombinase plasmid as described above. After marker recycle, clones were again observed under magnification to confirm absence of the clumping phenotype. A resulting identified strain, PNY2145, has the genotype: MATa ura3Δ::loxP his3Δ pdc5Δ::P[FBA (L8)]-XPK|xpk1_Lp-CYCt-loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66 amn1Δ::AMN1(y).

Example 2

Site Directed Mutagenesis of Δ9 Variant of S. Mutans DHAD

Amino acid replacements at positions 378, 383, 385, 387, and 388 were individually incorporated into a truncated version of *Streptococcus mutans* DHAD lacking the nine c-terminal amino acids (Δ9 variant) via site directed mutagenesis. Mutagenesis was performed with a yeast shuttle plasmid employing the QuikChange® Lightning Site-Directed Mutagenesis Kit (Catalog #210518; Agilent Technologies, Stratagene Products Division, La Jolla, Calif.). Mutagenesis primers listed in Table 11 were commercially synthesized by Integrated DNA Technologies, Inc. (Coralville, Iowa). Primers were combined into mixes, as indicated in Table 11 (column labeled "Mix").

TABLE 11

Primer Mixes Employed for Site Directed Mutagenesis

| Mix | SEQ ID NO: | Primers | Sequence |
| --- | --- | --- | --- |
| P2A1mix | 527 | P2A1 | GTTATTATGCCGCTTGAAAATGCTAAACGT GAAGATGGTCCGCTC |
| P2A1mix | 528 | P2A1rev | GAG CGG ACC ATC TTC ACG TTT AGC ATT TTC AAG CGG CAT AAT AAC |
| G2S2mix | 529 | G2S2 | GAAAATCCTAAACGTGAAGATTCTCCGCTC ATTATTCTCCATGG |
| G2S2mix | 530 | G2S2rev | TGG AGA ATA ATG AGC GGA GAA TCT TCA CGT TTA GGA TTT TC |
| L2F3mix | 531 | L2F3 | CTAAACGTGAAGATGGTCCGTTCATTATTC TCCATGGTAACTTGG |
| L2F3mix | 532 | L2F3rev | CCA AGT TAC CAT GGA GAA TAA TGA ACG GAC CAT CTT CAC GTT TAG |
| L2V4mix | 533 | L2V4 | CTAAACGTGAAGATGGTCCGGTCATTATTC TCCATGGTAACTTGG |
| L2V4mix | 534 | L2V4rev | CCA AGT TAC CAT GGA GAA TAA TGA CCG GAC CAT CTT CAC GTT TAG |
| I2V5mix | 535 | I2V5 | GAAGATGGTCCGCTCATTGTTCTCCATGGT AACTTGGC |
| I2V5mix | 536 | I2V5rev | GCC AAG TTA CCA TGG AGA ACA ATG AGC GGA CCA TCT TC |

TABLE 11-continued

Primer Mixes Employed for Site Directed Mutagenesis

| Mix | SEQ ID NO: | Primers | Sequence |
| --- | --- | --- | --- |
| I2M6mix | 537 | I2M6 | GAAGATGGTCCGCTCATTATGCTCCATGGT AACTTGGC |
| I2M6mix | 538 | I2M6rev | GCC AAG TTA CCA TGG AGC ATA ATG AGC GGA CCA TCT TC |
| L2I7mix | 539 | L2I7 | GAAGATGGTCCGCTCATTATTATCCATGGT AACTTGGCTCCAGAC |
| L2I7mix | 540 | L2I7rev | GTC TGG AGC CAA GTT ACC ATG GAT AAT AAT GAG CGG ACC ATC TTC |
| L2M8mix | 541 | L2M8 | GAAGATGGTCCGCTCATTATTATGCATGGT AACTTGGCTCCAGAC |
| L2M8mix | 542 | L2M8rev | GTC TGG AGC CAA GTT ACC ATG CAT AAT AAT GAG CGG ACC ATC TTC |

Except for the primers, templates, and double distilled water (ddH$_2$O), all reagents used here were supplied with the kit indicated above. A stock mixture for the eight mutagenesis reactions contained 1 µl of pLH691 (495 ng) (SEQ ID NO:590), 50 µl of 10× reaction buffer, 10 µl of dNTP mix, 15 µl of QuikSolution reagent, and 404 µl of ddH$_2$O. Each mutagenesis reaction mixture contained 48 ul of the stock mixture, 1 µl of a primer mix (10 uM each primer), and 1 µl of QuikChange Lightning Enzyme. The following conditions were used for the reactions: The starting temperature was 95° C. for 2 min followed by 18 heating/cooling cycles. Each cycle consisted of 95° C. for 20 sec, 60° C. for 10 sec, and 68° C. for 10 min. At the completion of the temperature cycling, the samples were incubated at 68° C. for 5.0 min and then held awaiting sample recovery at 4° C. 2 µl of the Dpn I was added to each reaction and the mixtures were incubated for 1 hr at 37° C.

2 µl of each mutagenic reaction was transformed into One Shot® Stbl3™ Chemically Competent *Escherichia coli* (*E. coli*) (Invitrogen, Catalog #C7373-03) or One Shot® TOP10 Chemically Competent *E. coli* (Invitrogen, Catalog #C404003) according to the manufacturer's instructions. The transformants were spread on agar plates containing the LB medium and 100 µg/ml ampicillin (Catalog #L1004, Teknova Inc. Hollister, Calif.) and incubated at 37° C. overnight. Multiple transformants for each reaction were inoculated into LB medium containing 100 µg/ml ampicillin and incubated at 37° C. with shaking at 225 rpm. Plasmid DNA was isolated from the cells with the QIAprep® Spin Miniprep Kit (Catalog #2706; Qiagen, Valencia, Calif.) according to the protocol provided by the manufacturer. Sequencing of the complete DHAD genes were performed with primers Dseq1 (aacgcgtgaagcttttgaagatg; SEQ ID NO:690), Dseq2 (tcagttcggaacaatcacgg; SEQ ID NO:691), Dseq3 (tgctttccctttcatcaatgattgttg, SEQ ID NO:692), Dseq4 (tccatgttagccatagcgataac SEQ ID NO:693), Dseq5 (ttgtgcttcaggagcgatatg; SEQ ID NO:694), N885 (ctgctaatgtggaattgacac, SEQ ID NO:695), and N929 (gtctgttacggctcccctag, SEQ ID NO:696). Two clones were prepared for each variant listed in Table 12, with the exception of delta9-L217, for which only a single clone was prepared.

TABLE 12

Prepared *Streptococcus mutans* DHAD delta9 (Δ9) Variants

| Variant | Nucleotide SEQ ID NO: | Amino Acid SEQ ID NO: | Substitution |
|---|---|---|---|
| delta9-P2A1 | 551 | 552 | P378A |
| delta9-G2S2 | 556 | 557 | G383S |
| delta9-L2F3 | 561 | 562 | L385F |
| delta9-L2V4 | 566 | 567 | L385V |
| delta9-I2V5 | 571 | 572 | I387V |
| delta9-I2M6 | 576 | 577 | I387M |
| delta9-L2I7 | 581 | 582 | L388I |
| delta9-L2M8 | 586 | 587 | L388M |

Example 3

Site Directed Mutagenesis of Full Length *Streptococcus mutans* (*S. mutans*) DHAD Full length versions of Δ9-L2V4 (substitution L385V), Δ9-I2V5 (substitution I387V), and Δ9-L2I7 (substitution L387I) were prepared by site directed mutagenesis of the wild type *S. mutans* DHAD. Site directed mutagenesis was performed as described in Example 2, with modifications.

For the L385V substitution, the mutagenesis reaction contained 1 ul pLH804 (50 ng) (SEQ ID NO:591), 1 ul L2V4mix (10 uM each primer), 1 ul dNTP mix, 1.5 ul Quiksolution, 5 ul of 10× buffer, 1 ul QuikChange® Lightning Enzyme, and 39.5 ul of distilled water (ddH$_2$O).

For the I387V substitution, the mutagenesis reaction contained 1 ul pLH804 (50 ng) (SEQ ID NO:591), 1 ul I2V5mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the L388I substitution, the mutagenesis reaction contained 1 ul pLH804 (50 ng) (SEQ ID NO:591), 1 ul L218 mix (10 uM each primer), 1 ul dNTP mix, 1.5 ul Quiksolution, 5 ul of 10× buffer, 1 ul QuikChange® Lightning Enzyme, and 39.5 ul of ddH$_2$O.

The following conditions were used for the reactions: The starting temperature was 95° C. for 2 min followed by 18 heating/cooling cycles. Each cycle consisted of 95° C. for 20 sec, 60° C. for 10 sec, and 68° C. for 10 min. At the completion of the temperature cycling, the samples were incubated at 68° C. for 5 min and then held awaiting sample recovery at 4° C. 2 ul of DpnI restriction enzyme was added to each reaction and the mixtures were incubated for 30 min at 37° C.

Three clones were prepared for variants L2V4 and I2V5 listed in Table 13, while two clones were prepared for variant L2I7.

TABLE 13

Prepared Variants of Full Length *S. mutans* DHAD

| Variant | Nucleotide SEQ ID NO: | Amino Acid SEQ ID NO: | Substitution |
|---|---|---|---|
| L2V4 | 564 | 565 | L385V |
| I2V5 | 569 | 570 | I387V |
| L2I7 | 579 | 580 | L388I |

Example 4

Isobutanol Production of *S. Mutans* DHAD Derivatives in PNY2115

Variants prepared in Examples 2 and Example 3 were analyzed for isobutanol production in yeast strain PNY2115, described in Example I (MATa ura3Δ::loxP his3Δ pdc5Δ:: loxP66/71 fra2Δ 2-micron plasmid (CEN.PK2) pdc1Δ::P [PDC1]-ALS|alsS_Bs-CYC1t-loxP71/66 pdc6Δ::(UAS) PGK1-P[FBA1]-KIVD|Lg(y)-TDH3t-loxP71/66 adh1Δ::P [ADH1]-ADH|Bi(y)-ADHt-loxP71/66 fra2Δ::P[ILV5]- ADH|Bi(y)-ADHt-loxP71/66 gpd2Δ::loxP71/66).

Growth Media

Four types of media were used during the growth procedure of yeast strains: SE-ura agar plate, SAG-2-ura agar plate, an aerobic pre-culture media and an anaerobic culture media. All chemicals were obtained from Sigma-Aldrich® (St. Louis, Mo.) unless otherwise noted.

Yeast transformation recovery plate (SE-ura): 50 mM 2-(N-morpholino)ethanesulfonic acid (MES) (pH 5.5), 6.7 g/L yeast nitrogen base without amino acids (Difco™, 291940, Sparks, Md.), 1.4 g/L yeast synthetic drop-out medium supplement without histidine, leucine, tryptophan and uracil, 0.2% ethanol, 0.01% weight per volume (w/v) leucine, 0.01% w/v histidine, and 0.002% w/v tryptophan.

Glucose adaptation plate (SAG-2-Ura): 50 mM MES (pH 5.5, 6.7 g/L yeast nitrogen base without amino acids (Difco™, 291940, Sparks, Md.), 1.4 g/L yeast synthetic drop-out medium supplement without histidine, leucine, tryptophan and uracil, 3 mM sodium acetate (pH 7.0), 2% w/v glucose, 0.01% w/v leucine, 0.01% w/v histidine, and 0.002% w/v tryptophan.

Aerobic pre-culture media (SAG-0.2-Ura): 6.7 g/L yeast nitrogen base without amino acids (Difco™, 291940, Sparks, Md.), 1.4 g/L yeast synthetic drop-out medium supplement without histidine, leucine, tryptophan and uracil, 3 mM sodium acetate (pH 7.0), 0.2% w/v glucose, 0.01% w/v leucine, 0.01% w/v histidine, and 0.002% w/v tryptophan.

Anaerobic culture media (SAG-3-Ura): 50 mM MES (pH 5.5, 6.7 g/L yeast nitrogen base without amino acids (Difco™, 291940, Sparks, Md.), 1.4 g/L yeast synthetic drop-out medium supplement without histidine, leucine, tryptophan and uracil, 3 mM sodium acetate (pH 7.0), 3% w/v glucose, 0.01% w/v leucine, 0.01% w/v histidine, 0.002% w/v tryptophan, 30 mg/L nicotinic acid, 30 mg/L thiamine and 10 mg/L ergosterol made up in 50/50 volume per volume (v/v) Tween/ethanol solution.

Transformation and Glucose Adaptation

Competent cells of the PNY2115 (MATa ura3Δ::loxP his3Δ pdc5Δ::loxP66/71 fra2Δ 2-micron plasmid (CEN.PK2) pdc1Δ::P[PDC1]-ALS|alsS_Bs-CYC1t- loxP71/66 pdc6Δ::(UAS)PGK1-P[FBA1]-KIVD|Lg(y)- TDH3t-loxP71/66 adh1Δ::P[ADH1]-ADH|Bi(y)-ADHt- loxP71/66 fra2Δ::P[ILV5]-ADH|Bi(y)-ADHt-loxP71/66 gpd2Δ::loxP71/66) were prepared and transformed with 1 μL of purified plasmid (~0.4 to 0.8 μg total DNA) using a Frozen-EZ Yeast Transformation II Kit™ (Zymo Research Corp.; Irvine, Calif.). Transformation mixtures were plated on SE-ura plates and incubated at 30° C. for 4 days. Three or four colonies for each transformant were selected and patched onto SE-ura plates and incubated at 30° C. for 2 days. The variants then underwent glucose adaptation by patching onto SAG-2-Ura plates and growing for 2 days at 30° C.

Deep-Well Plate Growth Procedure 1.5 mL aliquots of the aerobic pre-culture media were dispensed into each well of a VWR 48 deep-well plate (#82004-674, VWR, Radnor, Pa.) and inoculated with cells grown on a SAG-2-Ura agar plate, as described above. A sterile air permeable cover (#60941-086, VWR, Radnor, Pa.) was used to seal the culture plate. The plate was placed in a 30° C. incubator and was grown for 20 to 24 hours with shaking, and an OD600 value (optical density at 600 nm) was obtained using Spectra Max384 Plus plate reader (Molecular Devices, Sunnyvale, Calif.). OD600 values were converted to equivalent OD600 values on a Cary 300 (Agilent Technologies, Wilmington, Del.) calibration value. A dilution 48 deep-well plate was set with a target Cary OD600 value of 0.35 for each well in a total volume of 1.5 mL. Wells with Cary OD600 values of 0.35 to 0.40 were transferred directly from the original plate to the dilution plate. For all other wells, a volume of turbid culture was transferred the volume was brought up to 1.5 mL with aerobic pre-culture media. The 48 deep-well plate was returned to the 30° C. shaking incubator and grown for an additional 20 to 24 hours. OD600 values were obtained as described above.

Serum Vial Growth Procedure

The final volume of medium in each 15 mL serum vial was 10 mL of medium. Target inoculation OD600 value of 0.1 was set for each vial. Turbid culture volume was based on the equivalent Cary 3000D600 values obtained from each well of the dilution 48 deep-well plate described in the previous section. Anaerobic culture media was added to bring the final volume up to 10 mL. Serum vials were then capped and crimped. Vials were placed in a 30° C. shaking incubator and grown for 40-50 hours. Inoculation of the serum vials were performed under aerobic conditions. Wells that did not have and OD600 value of at least 0.3 were not inoculated into serum vials.

High-Performance Liquid Chromatography (HPLC) Analysis

Samples were taken for HPLC analysis and to obtain OD600 values at the end of the anaerobic growth period. Serum vials were opened and an aliquot of turbid culture was removed and filtered in preparation for HPLC analysis. Another aliquot was removed for OD600 determination (described above). The remaining turbid culture was centrifuged. The resulting supernatant was discarded and the cell pellet was saved by freezing at −80° C. in the event additional analysis was required.

HPLC analysis was performed using a Waters 2695 separations unit, 2996 photodiode array detector, and 2414 refractive index detector (Waters, Milford, Mass.) with a Shodex Sugar SH-G pre-column and Shodex Sugar SH1011 separations column (Shodex, J M Science, Grand Island, N.Y.). Compounds were separated by isocratic elution at 0.01 N sulfuric acid with a flow rate of 0.5 mL/min. Chromatograms were analyzed using the Waters Empower Pro software.

Isobutanol Titer and Molar Yield for *Streptococcus mutans* (*S. Mutans*) Delta9 (Δ9) DHAD Variants Clones 1 and 2

PNY2115 with *S. mutans* variants described in Example 2 were grown and analyzed as described above. Isobutanol titer and molar yield are listed in Tables 14 and 11 below.

TABLE 14

S. mutans Δ9 DHAD variants (clone 1 set) in PNY2115

| Clone | Isobutanol mM at 46 hr | | Molar Yield | |
|---|---|---|---|---|
| | Mean | SD | Mean | SD |
| delta9 control (pLH691)(SEQ ID NO: 590) | 45 | 4.4 | 0.40 | 0.02 |
| delta9-P2A1 #1 | 0 | 0 | 0 | 0 |
| delta9-G2S2 #1 | 0.2 | 0.3 | 0.01 | 0.002 |
| delta9-L2F3 #1 | 10 | 1.4 | 0.31 | 0.02 |
| delta9-L2V4 #1 | 18 | 21 | 0.3 | 0.2 |
| delta9-I2V5 #1 | 51 | 1.4 | 0.53 | 0.01 |
| delta9-I2M6 #1 | 0 | 0 | 0.42 | 0.04 |
| delta9-L2I7 #1 | 25 | 5.3 | 0.44 | 0.02 |
| delta9-L2M8 #1 | 30 | 1.7 | 0.51 | 0.02 |

TABLE 15

S. mutans Δ9 DHAD variants (clone 2 set) in PNY2115

| Clone | Isobutanol mM at 46 hr | | Molar Yield | |
|---|---|---|---|---|
| | Mean | SD | Mean | SD |
| delta9 control (pLH691)(SEQ ID NO: 590) | 55 | 15 | 0.42 | 0.02 |
| delta9-L2F3 #2 | 13 | 0.5 | 0.24 | 0.02 |
| delta9-L2V4 #2 | 55 | 15 | 0.20 | 0.09 |
| delta9-I2V5 #2 | 49 | 9 | 0.40 | 0.03 |
| delta9-L2M8 #2 | 35 | 7 | 0.36 | 0.04 |

Isobutanol Titer and Molar Yield for *Streptococcus mutans* (*S. Mutans*) DHAD Variants PNY2115 with *S. mutans* variants described in Example 3 were grown and analyzed as described above. Isobutanol titers and molar yield are listed in Table 16 below.

TABLE 16

S. mutans DHAD variants (full length) in PNY2115

| Clone | Isobutanol mM 50 hr | | Molar Yield | |
|---|---|---|---|---|
| | Mean | SD | Mean | SD |
| WT Control (pLH804)(SEQ ID NO: 591) | 51 | 3 | 0.54 | 0.01 |
| 804-L2V4 Clone #1 | 82 | 10 | 0.63 | 0.01 |
| 804-I2V5 Clone#1 | 49 | 5 | 0.55 | 0.02 |
| 804-I2V5 Clone#2 | 41 | 14 | 0.51 | 0.04 |

Figure 3:
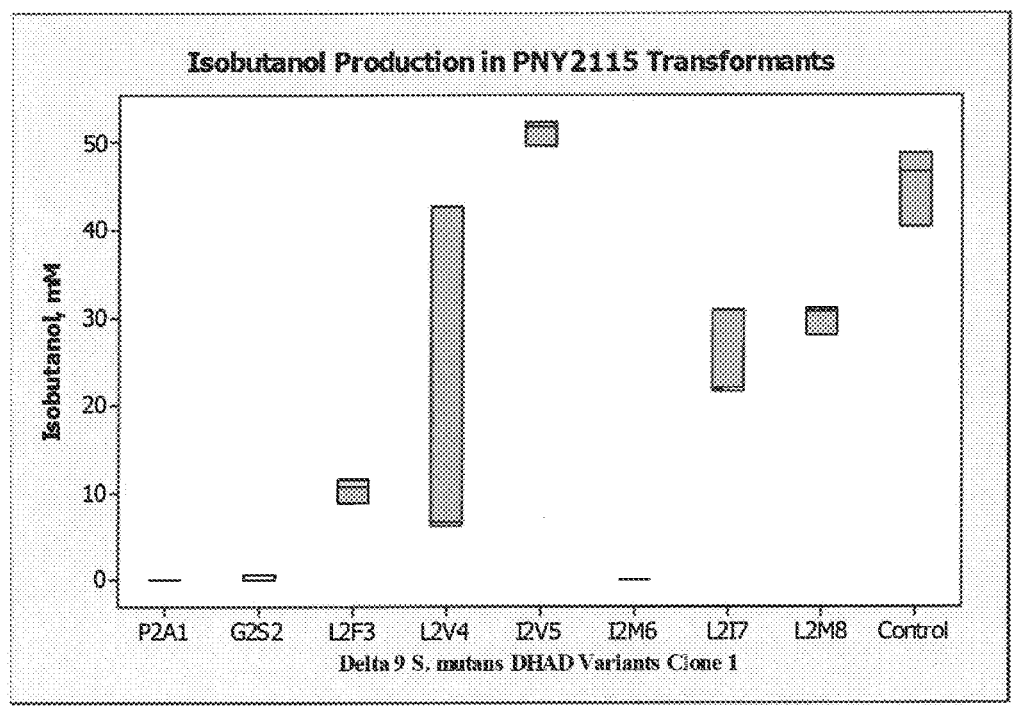
FIG. 3 is a graph illustrating isobutanol production in yeast strain PNY2115 transformants harboring Δ9 (Delta 9) *S. mutans* DHAD variants (P2A1, G2S2, L2F3, L2V4, I2V5, I2M6, L217, and L2M8) and the parental Δ9 *S. mutans* DHAD (control).

FIG. 3 is a graph illustrating the isobutanol production in yeast strain PNY2115 transformants harboring Δ9 (Delta 9) *S. mutans* DHAD variants (P2A1, G2S2, L2F3, L2V4, I2V5, I2M6, L2I7, and L2M8) and the parental Δ9 *S. mutans* DHAD (control).

Figure 4:
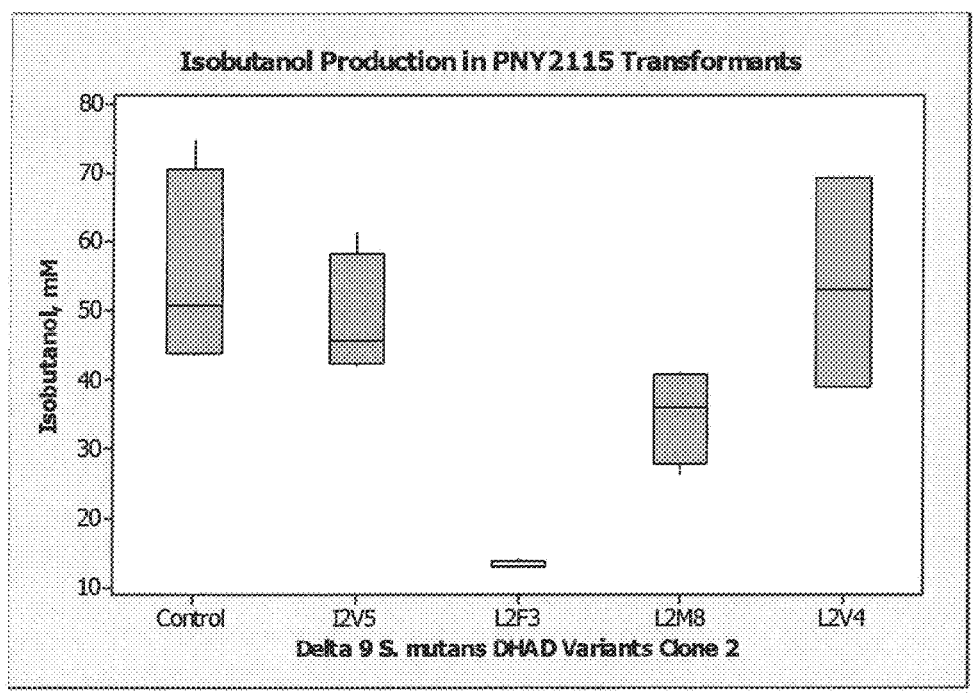
FIG. 4 is a graph illustrating the isobutanol production in yeast strain PNY2115 transformants harboring Δ9 *S. mutans* DHAD variants (I2V5, L2F3, L2M8, and L2V4) and the parental Δ9 *S. mutans* DHAD (control).

FIG. 4 is a graph illustrating the isobutanol production in yeast strain PNY2115 transformants harboring Δ9 *S. mutans* DHAD variants (I2V5, L2F3, L2M8, and L2V4) and the parental Δ9 *S. mutans* DHAD (control).

Figure 5:
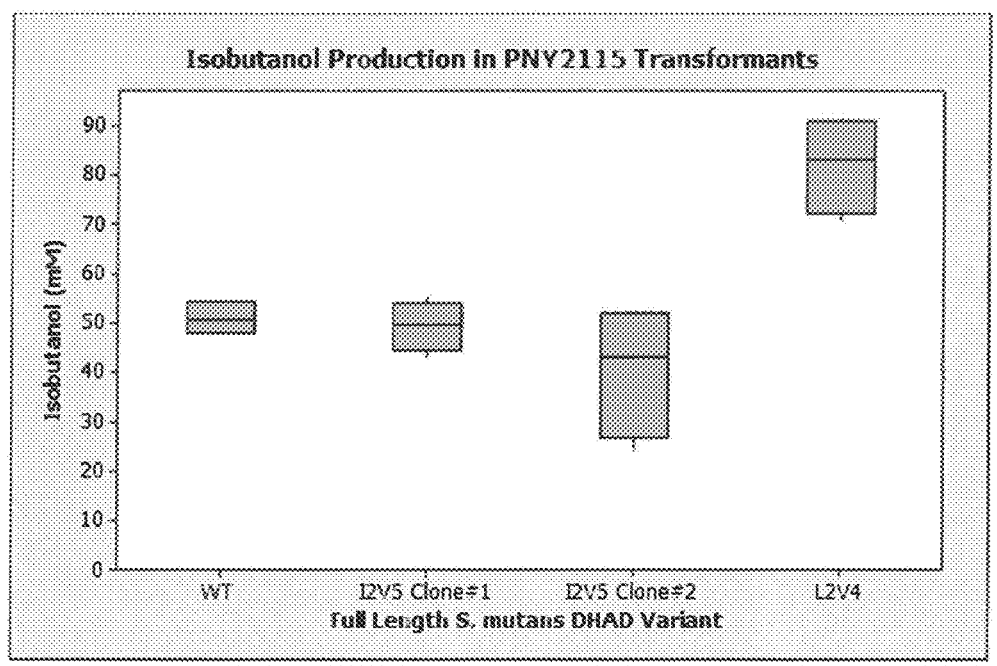
FIG. 5 is a graph illustrating the isobutanol production in yeast strain PNY2115 transformants harboring full length *S. mutans* DHAD variants (I2V5 clones 1 and 2 and L2V4) and the parental full length *S. mutans* DHAD (WT).

FIG. 5 is a graph illustrating the isobutanol production in yeast strain PNY2115 transformants harboring full length *S. mutans* DHAD variants (I2V5 clones 1 and 2 and L2V4) and the parental full length *S. mutans* DHAD (WT).

Figure 6:
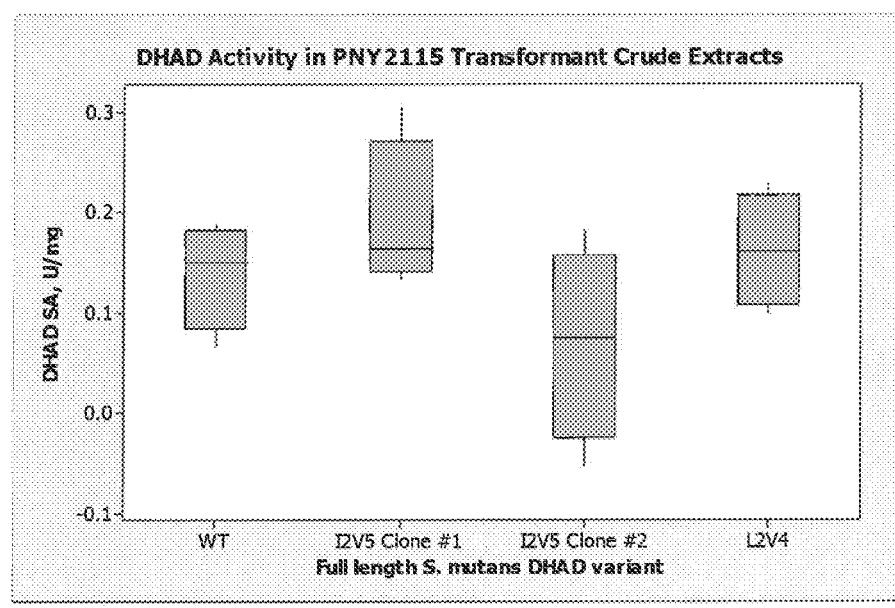
FIG. 6 is a graph illustrating DHAD activity in yeast strain PNY2115 harboring full length *S. mutans* DHAD variants (I2V5 clone 1, I2V5 clone 2, and L2V4) and the parental full length *S. mutans* DHAD (WT).

FIG. 6 is a graph illustrating DHAD activity in yeast strain PNY2115 harboring full length *S. mutans* DHAD variants (I2V5 clone 1, I2V5 clone 2, and L2V4) and the parental full length *S. mutans* DHAD (WT).

Example 5

DHAD Specific Activities for *Streptococcus mutans* (*S. Mutans*) DHAD Derivatives in Crude Extracts of PNY2115

DHAD specific activities were measured in crude extracts of yeast strain PNY2115 transformed with either the wild type *S. mutans* DHAD or variants of the full length enzyme containing a single amino acid change at position 385, position 387, or position 388.

Following 40-50 hr of growth in serum vials as described in Example 3, yeast cells were centrifuged and resultant pellets stored at −80° C. Frozen yeast cells were later thawed, resuspended in 0.1 M K-Hepes pH 6.8 containing 10 mM MgCl$_2$ and a protease inhibitor cocktail (Roche, Catalog #11873580001), and then broken by bead beating. The broken cells were centrifuged to remove the cell debris and generate the yeast crude extract. Protein concentrations (mg/ml) of extracts were measured with the Pierce Coomassie Plus (Bradford) Protein Assay (Catalog #23236, Thermoscientific). DHAD enzyme activities were measured spectrophotometrically in an end point assay using the 2,4-dinitrophenylhydrazine (2,4-DNPH) method as described in Flint, D. H. and M. H. Emptage, *J. Biol. Chem.* 263:3558-64 (1988), with modifications. The assay buffer contained 0.1 M K-Hepes pH 6.8 and 10 mM MgCl$_2$. Yeast extracts were diluted in assay buffer. Sufficient (R)-2,3-dihydroxyisovaleric acid was added to assay buffer so that the final concentration in the assay is 10 mM. In each assay, an enzyme containing solution and sufficient substrate containing buffer are mixed so that the final volume is 300 ul. Assay mixtures were incubated at 30° C. for 20 minutes. At five minute intervals, a 60 ul aliquot of each reaction was mixed with 70 ul of a saturated solution of 2,4-DNPH in 1 N HCl. Following a 30 minute incubation at room temperature, 70 ul of 4 N KOH in ethanol was then added to the solution, followed by brief mixing. The absorbance of the mixture was read at 540 nm with a Spectra Max384 Plus plate reader (Molecular Devices, Sunnyvale, Calif.). A standard curve containing 0 to 1.33 mM α-ketoisovalerate was employed to calculate enzyme activities (U/ml) for the conversion of (R)-2,3-dihydroxyvalerate to α-ketoisovalerate in the assays. DHAD specific activities (U/mg) were determined from enzyme activities (U/ml) and protein concentrations (mg/ml) measured for each sample. Averages for each clone evaluated are provided in Table 17.

TABLE 17

DHAD specific activities in PNY2115 extracts

| Clone | DHAD SA U/mg | |
|---|---|---|
| | Mean | SD |
| WT Control (pLH804)(SEQ ID NO: 591) | 0.14 | 0.05 |
| 804-L2V4 Clone #1 | 0.16 | 0.06 |
| 804-I2V5 Clone#1 | 0.19 | 0.08 |
| 804-I2V5 Clone#2 | 0.08 | 0.08 |

Example 6

DHIV Accumulation Levels for *S. Mutans* DHAD Derivatives in PNY2115

Wild type *S. mutans* DHAD and the full length variants prepared in Example 2 were transformed into yeast strain PNY2115 and analyzed for levels of DHIV accumulation and isobutanol production. Cultures were grown as described in Example 4, with the modification that samples were removed for analysis following 26 hr and 48 hr of growth. In addition to the analyses described in Example 4, samples were subjected to liquid chromatography-mass spectrometry ("LC/MS") to measure levels of DHIV. LC/MS quantitation was performed as described in U.S. Patent Appl. Pub. No. 2012/0258873, incorporated by reference herein. As shown in Tables 18 and 19, replacement of wild type DHAD with the variants results in DHIV accumulation levels and DHIV/isobutanol ratios that are equivalent to or lower than the wild type control.

TABLE 18

Isobutanol and DHIV levels at 26 hr growth in serum vials

| Clone | Isobutanol mM | | DHIV mM | | DHIV/ Isobutanol | |
|---|---|---|---|---|---|---|
| | Mean | SD | Mean | SD | Mean | SD |
| WT Control (pLH804) (SEQ ID NO: 591) | 7 | 1 | 0.3 | 0.2 | 0.043 | 0.017 |
| 804-L2V4 Clone #1 | 9 | 4 | 0.1 | 0.05 | 0.011 | 0.001 |
| 804-I2V5 Clone#1 | 4 | 3 | 0.2 | 0.1 | 0.050 | 0.012 |

TABLE 19

Isobutanol and DHIV levels at 48 hr growth in serum vials

| Clone | Isobutanol mM | | DHIV mM | | DHIV/ Isobutanol | |
|---|---|---|---|---|---|---|
| | Mean | SD | Mean | SD | Mean | SD |
| WT Control (pLH804) (SEQ ID NO: 591) | 35 | 2 | 1.3 | 0.5 | 0.038 | 0.011 |
| 804-L2V4 Clone #1 | 57 | 18 | 0.8 | 0.4 | 0.012 | 0.005 |
| 804-I2V5 Clone#1 | 24 | 14 | 0.6 | 0.4 | 0.026 | 0.004 |

Figure 7:
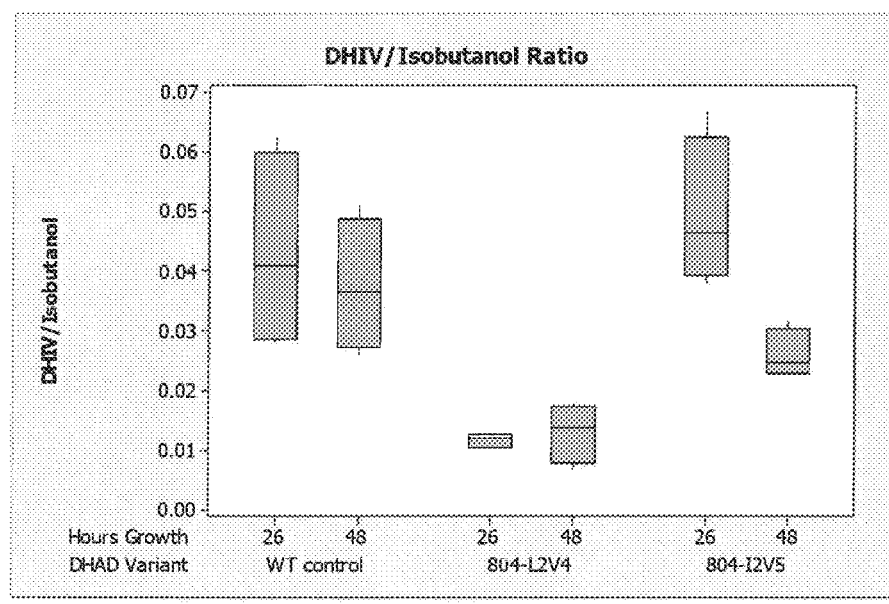
FIG. 7 is a graph illustrating DHIV accumulation in yeast strain PNY2115 harboring full length *S. mutans* DHAD variants (804-L2V4 and 804-I2V5) and the parental full length *S. mutans* DHAD (WT control).

FIG. 7 is a graph illustrating DHIV accumulation in yeast strain PNY2115 harboring full length *S. mutans* DHAD variants (804-L2V4 and 804-I2V5) and the parental full length *S. mutans* DHAD (WT control).

Example 7

Isobutanol Production with I2V5 ilvD Variant

TABLE 20

Strain referenced in Example 7

| Strain Name | Genotype | Description |
|---|---|---|
| PNY1665 | MATa ura3Δ::loxP pdc5Δ::loxP66/71 fra2Δ::P[ILV5]-ADH\|Bi(y)-ADHt-loxP71/66 2-micron plasmid (CEN.PK2) pdc1Δ::P[PDC1]-ALS\|alsS_Bs-CYC1t-loxP71/66 pdc6Δ::(UAS)PGK1-P[FBA1]-KIVD\|Lg(y)-TDH3t-loxP71/66 adh1Δ::P[ADH1]-ADH\|Bi(y)-ADHt-loxP71/66 gpd2Δ::loxP71/66 amn1Δ::AMN1 | herein |

Plasmid Construction

Plasmids were constructed in a 2-micron based *Saccharomyces cerevisiae-Escherichia coli* shuttle vector.

pBP3765—C-Terminal Tagged I2V5 ilvD_Sm pBP3765 (SEQ ID NO:699) was constructed to contain a chimeric gene having the coding region of the I2V5 mutant ilvD gene from *Streptococcus mutans* (nt position 5377-3665) followed by a Lumio™ tag sequence (nt 3664-3647; Invitrogen, Carlsbad, Calif.; Adams et al. J. Am. Chem. Soc., 124:6063, 2002) expressed from the yeast TEF1 mutant 7 promoter (nt 5787-5387; Nevoigt et al. Applied and Environmental Microbiology, 72:5266, 2006), and followed by the FBA1 terminator (nt 3632-3320) for expression of DHAD, and a chimeric gene having the coding region of the K9JB4P mutant ilvC gene from *Anaeropstipes cacae* (nt 1628-2659; described in Int'l Pub. No. WO2012/12955, which is incorporated by reference herein) expressed from the yeast ILV5 promoter (nt 434-1614) and followed by the ILV5 terminator (nt 2673-3307) for expression of KARI.

Strain Construction

Following conversion of PNY2115 to PNY2121 by replacing the endogenous copy of AMN1 with a codon-optimized version of the AMN1 gene from CEN.PK2 (SEQ ID NO:722), PNY2121 was restored back to a histidine prototroph. The HIS3 coding sequence and 500 bp upstream and downstream of the coding sequence were amplified from a haploid (PNY0865) obtained from sporulation of PNY0827. PNY2121 was transformed with the resulting PCR product and transformants were selected on agar plates containing synthetic complete media lacking histidine supplemented with 1% ethanol at 30° C. A PNY2121 HIS3+ isolate was designated PNY1665.

PNY1665 was transformed with the plasmids described above and transformants were selected on agar plates containing synthetic complete media lacking uracil supplemented with 1% ethanol at 30° C. Three transformants were selected for each plasmid construct.

Isobutanol Production

Isobutanol production was tested for the isobutanologen strains described above. Strains were grown overnight in 10 ml of low glucose medium in 125 ml VWR vent cap shake flasks at 30° C. at 250 RPM in a New Brunswick I24 incubated shaker. The low glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.2% w/v ethanol, 0.3% w/v glucose, and 100 mM 2-Morpholinoethanesulphonic acid (MES) buffer, adjusted to pH 5.5 with KOH. Overnight cultures were sub-cultured into the same medium to an OD600 of 0.4, and glucose was added to a final concentration of 3% w/v 15 ml of culture in 125 ml VWR vent cap shake flasks were grown for 4 hours at 30° C. at 250 RPM in a New Brunswick I24 incubated shaker. Cells were centrifuged at 3800×g for 5 minutes at room temperature and cell pellets were resuspended in high glucose medium to an OD600 of 0.2. High glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.1% w/v ethanol, 3.0% w/v glucose, and 100 mM 2-Morpholinoethanesulphonic acid (MES) buffer, adjusted to pH 5.5 with KOH. 10 ml of the culture in high glucose medium was transferred to a 20 ml serum vial (Kimble Chase; Vineland, N.J.). Serum vials were sealed and cultures were grown at 30° C. at 250 RPM in a New Brunswick I24 incubated shaker for 44 hours.

After 44 hours, the cultures were sampled for OD600 and culture supernatants (collected using Spin-X centrifuge tube filter units, Costar Cat. No. 8169) were analyzed by HPLC (Example 4). OD600, isobutanol concentration, and isobutanol molar yield are presented in Table 21.

TABLE 21

Average OD600, isobutanol concentration, and isobutanol molar yield and standard deviations.

| | OD600 | Isobutanol (mM) | Isobutanol Yield (mol/mol) |
|---|---|---|---|
| PNY1665/pLH689 | 2.1 ± 0.1 | 112.0 ± 3.0 | 0.69 ± 0.01 |
| PNY1665/pBP3765 | 2.2 ± 0.0 | 96.2 ± 5.1 | 0.67 ± 0.02 |

Example 8

Construction of Additional Yeast Strains

The following table provides the genotypes of the various yeast strains referenced in the following Examples.

TABLE 22

Strains referenced in the following Examples

| Strain Name | Genotype |
|---|---|
| PNY2115 | MATa ura3Δ::loxP his3Δ pdc5Δ::loxP66/71 2-micron plasmid (CEN.PK2) pdc1Δ::P[PDC1]-ALS\|alsS_Bs-CYC1t-loxP71/66 pdc6Δ::(UAS)PGK1-P[FBA1]-KIVD\|Lg(y)-TDH3t-loxP71/66 adh1Δ::P[ADH1]-ADH\|Bi(y)-ADHt-loxP71/66 fra2Δ::P[ILV5]-ADH\|Bi(y)-ADHt-loxP71/66 gpd2Δ::loxP71/66 |
| PNY1566 | MATa ura3Δ::loxP pdc5Δ::loxP66/71 2-micron plasmid (CEN.PK2) pdc1Δ::P[PDC1]-ALS\|alsS_Bs-CYC1t-loxP71/66 pdc6Δ::(UAS)PGK1-P[FBA1]-KIVD\|Lg(y)-TDH3t-loxP71/66 adh1Δ::P[ADH1]-ADH\|Bi(y)-ADHt-loxP71/66 fra2Δ::P[ILV5]-ADH\|Bi(y)-ADHt-loxP71/66 gpd2Δ::loxP71/66 |
| PNY1602 and PNY1612 | PNY1566 with plasmid pLH689 containing (P[ILV5]-KARI\|ilvC_Ll-ILV5t P[TEF1(M7)]-DHAD\|ilvD_Sm-lum-FBA1t) |

TABLE 22-continued

Strains referenced in the following Examples

| Strain Name | Genotype |
|---|---|
| PNY1604 and PNY1614 | PNY1566 with plasmid pLH804 containing (P[ILV5]-KARI\|ilvC_Ll-ILV5t P[TEF1(M7)]-DHAD\|ilvD_Sm-FBA1t) |

To obtain PNY0865, PNY0827 was sporulated using standard methods (Codón A C, Gasent-Ramírez J M, Benítez T. Factors which affect the frequency of sporulation and tetrad formation in *Saccharomyces cerevisiae* baker's yeast. Appl. Environ. Microbiol. 1995). After the formation of asci (as observed by microscopy), a 100 ul aliquot of cells was resuspended in 100 ul of 1 M sorbitol and treated with 5 U of zymolyase (Zymo Research, Orange Calif.) at 37° C. for 15 min. Resulting tetrads were spread on YPD medium and dissected using a micromanipulator (Singer Instruments, Somerset UK), and the single-spore isolates were grown at 30° C. for 3 d to form colonies. One tetrad with four viable spores was characterized further. The mating type of the single-spore isolates was determined by PCR as described (Huxley, C., E. D. Green and I. Dunham (1990). "Rapid assessment of *S. cerevisiae* mating type by PCR." Trends Genet. 6(8): 236). One spore isolate, of mating type MATa, was designated PNY0865.

PNY2115 was restored back to a histidine prototroph. The HIS3 coding sequence and 500 base pairs (bp) upstream and downstream of the coding sequence were amplified from the haploid PNY0865. PNY2115 was transformed with the resulting PCR product and transformants were selected on agar plates containing synthetic complete media lacking histidine supplemented with 1% ethanol at 30° C. A PNY2115 HIS3+ isolate was designated PNY1566.

PNY1566 was transformed with pLH804 (ilvD_Sm; SEQ ID NO:591) and transformants were selected on agar plates containing synthetic complete media lacking uracil supplemented with 1% ethanol at 30° C. Two transformants were selected and designated PNY1604 and PNY1614. PNY1566 was transformed with pLH689 (tagged ilvD_Sm) and transformants were selected on agar plates containing synthetic complete media lacking uracil supplemented with 1% ethanol at 30° C. Two transformants were selected and designated PNY1602 and PNY1612.

Example 9

DHAD Activity of Variant DHADs

PNY1604, PNY1614, PNY1602, and PNY1612 were grown overnight in 12 ml of low glucose medium in 125 ml VWR vent cap shake flasks at 30° C. at 250 RPM in a New Brunswick I24 incubated shaker. The low glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.2% weight per volume (w/v) ethanol, 0.3% w/v glucose, 100 mM 2-Morpholinoethanesulphonic acid (MES) buffer, adjusted to pH 5.5 with KOH. Overnight cultures were centrifuged at 3800×g for 5 minutes at room temperature and cell pellets were resuspended in 1 ml of high glucose medium. High glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.1% w/v ethanol, 3.0% w/v glucose, 100 mM 2-Morpholinoethanesulphonic acid (MES) buffer, adjusted to pH 5.5 with KOH. 15 ml of high glucose medium in 125 ml VWR vent cap shake flasks was inoculated with cells to a final OD600 0.4 and grown for 5 hours at 30° C. at 250 RPM in a New Brunswick I24 incubated shaker. Cells were again centrifuged at 3800×g for 5 minutes at room temperature and cell pellets were resuspended in 2 ml of high glucose medium. 30 ml of high glucose medium in 60 ml serum vials (Kimble Chase; Vineland, N.J.) was inoculated with resuspended cells to a final OD600 of 0.15. Serum vials were sealed and cultures were grown at 30° C. at 250 RPM in a New Brunswick I24 incubated shaker for 20 hours. Cultures were centrifuged at 3800×g for 5 minutes at 4° C. The pellets were washed with cold 50 mM HEPES pH 6.8 and then centrifuged at 3800×g for 5 minutes at 4° C. Cell pellets were frozen on dry ice and stored at −80° C. until they were assayed for DHAD activity.

For DHAD activity measurements the frozen yeast cells were thawed, resuspended in 0.1 M K-Hepes pH 6.8 containing 10 mM $MgCl_2$ and a protease inhibitor cocktail (Roche, Catalog #11873580001), and then broken by bead beating. The broken cells were centrifuged to remove the cell debris and generate the yeast crude extract. Protein concentrations (mg/ml) of extracts were measured with the Pierce Coomassie Plus (Bradford) Protein Assay (Catalog #23236, Thermoscientific). DHAD enzyme activities were measured spectrophotometrically in an end point assay using the 2,4-dinitrophenylhydrazine (2,4-DNPH) method as described in Flint, D. H. and M. H. Emptage, J. Biol. Chem. 263:3558-64, 1988, with modifications. The assay buffer contained 0.1 M K-Hepes pH 6.8 and 10 mM $MgCl_2$. Yeast extracts were diluted in assay buffer. Sufficient (R)-2,3-dihydroxyisovaleric acid was added to assay buffer so that the final concentration in the assay is 10 mM. In each assay, an enzyme containing solution and sufficient substrate containing buffer are mixed so that the final volume is 300 ul. Assay mixtures were incubated at 30° C. for 20 minutes. At five minute intervals, a 60 ul aliquot of each reaction was mixed with 70 ul of a saturated solution of 2,4-DNPH in 1 N HCl. Following a 30 minute incubation at room temperature, 70 ul of 4 N KOH in ethanol was then added to the solution, followed by brief mixing. The absorbance of the mixture was read at 540 nm with a Spectra Max384 Plus plate reader (Molecular Devices, Sunnyvale, Calif.). A standard curve containing 0 mM to 1.33 mM α-ketoisovalerate was employed to calculate enzyme activities (units per milliliter, U/ml) for the conversion of (R)-2,3-dihydroxyvalerate to α-ketoisovalerate in the assays. DHAD specific activities (units per milligram, U/mg) were determined from enzyme activities (U/ml) and protein concentrations (mg/ml) measured for each sample.

Figure 8:
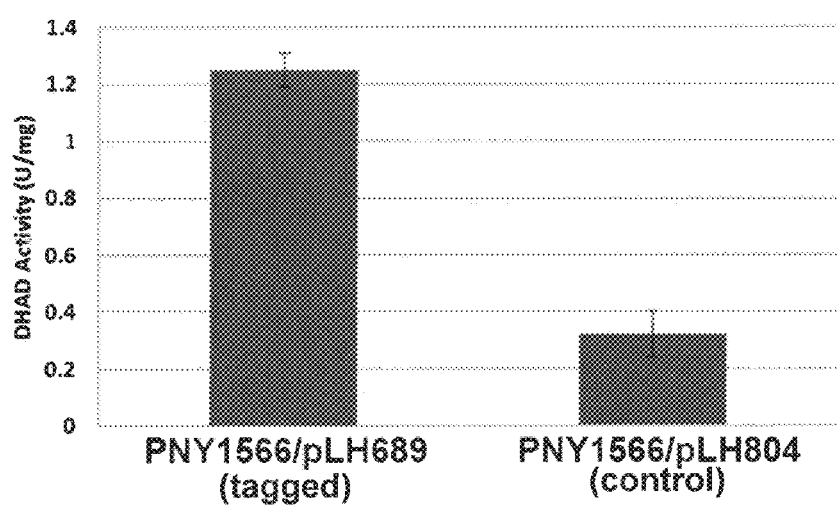
FIG. 8 is a graph illustrating DHAD activity in yeast strains expressing full length *S. mutans* DHAD) (PNY1566/pLH804 (control)) and a tagged *S. mutans* DHAD (PNY1566/pLH689 (tagged)).

Strains PNY1604 and PNY1614 containing the control ilvD_Sm had an average DHAD activity of 0.32 U/mg. See FIG. 8. Strains PNY1602 and PNY1612 containing the tagged ilvD_Sm had an average DHAD activity of 1.25 U/mg. See FIG. 8.

Example 10

Constructs for Expressing Variant DHAD in Yeast Strain BY4741

Vector derived from pHR81 (ATCC 87541) was used for expressing the wild type and mutant DHAD from *S. mutans* under the control of FBA promoter. Vector pHR81 FBA-IlvD(Sm) contained wild-type (WT) DHAD. In this vector, the FBA promoter is in the region from nucleotides (nt) 7626 to 8623. The IlvD gene is from nt 8631 to 10343 flanked by restriction sites SpeI and NotI. For the expression of the IlvD protein containing a C-terminal tag, vector pHR81 FBA-IlvD(Sm)-lum was used. In this vector, the IlvD gene was located between nt 8631 to 10343 and a C-terminal tag sequence (SEQ ID NO:785) was added in frame from 10344 to 10364.

Example 11

DHAD Activity Measurement in Yeast Strain BY4741

Vectors pHR81 FBA-IlvD(Sm) (SEQ ID NO:788) and pHR81 FBA-IlvD (Sm)-lum (SEQ ID NO:789) were transformed into yeast strain BY4741. Competent cells were prepared with a Frozen Yeast Transformation kit (Zymo Research). The transformants were selected on plates with complete synthetic yeast growth medium minus Ura (Teknova). Growth on liquid medium was carried out by adding 5 ml of an overnight culture into 100 ml medium in a 250 ml flask. Cells from 80 ml culture were harvested by centrifugation (4,000 rpm for 10 min at 4° C.) and washed with 10 ml TM8 buffer (50 mM Tris, pH 8.0, 10 mM $MgSO_4$) stored at 4° C. The cells were resuspended in 1 ml of TM8 and transferred to a lysing matrix tubes with 0.1 mm silica spheres (MP Biomedicals, Solon, Ohio). The cells were broken with a beads beater (4× with 30 seconds each). The crude extract was obtained by centrifugation with a table top microfuge at 12,000 rpm at 4° C. for 30 min. The supernatants were removed and stored on ice until assayed as described above.

Figure 9:
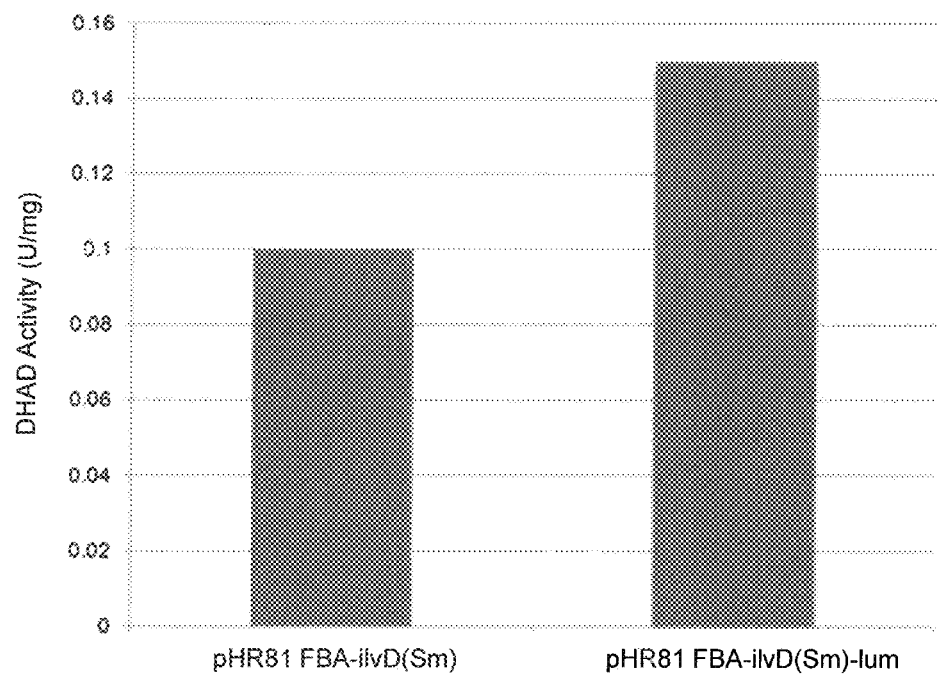
FIG. 9 is a graph illustrating DHAD activity in yeast strains expressing full length *S. mutans* DHAD (pHR81 FBA-ilvD(Sm)) and a C-terminal-tagged *S. mutans* DHAD (pHR81 FBA-ilvD(Sm)-lum).

It was found that the DHADs assayed herein were stable in crude extracts kept on ice for a few hours. The activity was also preserved when samples were frozen in liquid $N_2$ and stored at −80° C. Unexpectedly, results from enzymatic measurement (FIG. 9) showed that about 50% increase in activity with the IlvD enzyme containing a tag at the C-terminus as compared to the activity obtained with the wild-type (WT) enzyme.

Example 12

C-Terminal-Tagged DHAD Expression Strains

Plasmid and Strain Construction

Plasmids were constructed in a pRS423-based 2-micron *Saccharomyces cerevisiae-Escherichia coli* shuttle vector. Genes encoding the DHAD sequence or the C-terminal-tagged DHAD sequence were cloned into the PmlI and NotI restriction sites of the plasmid, such that the gene was expressed from the yeast FBA1 promoter and followed by the yeast FBA1 terminator. All genes, except the *Streptococcus mutans* ilvD gene, were synthesized codon optimized for expression in *Saccharomyces cerevisiae* (Genscript, Piscataway, N.J.). The native sequence was utilized for the *Streptococcus mutans* ilvD gene. The predicted *Zea mays* chloroplast targeting peptide sequence was not included in the synthesized gene. The sequence encoding the first 33 amino acids was removed and replaced with a methionine codon. The predicted *Neurospora crassa* mitochondrial targeting peptide sequence was not included in the synthesized gene. Two start sites were tested. Construct *Neurospora crassa* DHAD(1) had the sequence encoding the first 32 amino acids removed and replaced with a methionine codon. Construct *Neurospora crassa* DHAD(2) had the sequence encoding the first 36 amino acids removed and replaced with a methionine codon.

pBP4582 (SEQ ID NO:790) was constructed to contain a chimeric gene having the coding region of the ilvD gene from *Streptococcus mutans* (nt position 2260-3972) expressed from the yeast FBA1 promoter (nt 1661-2250) and followed by the FBA1 terminator (nt 3984-4296) for expression of the *Streptococcus mutans* DHAD with no C-terminal tag.

pBP1296 (SEQ ID NO:791) was constructed to contain a chimeric gene having the coding region of the ilvD gene from *Streptococcus mutans* (nt position 2260-3972) followed by a C-terminal tag sequence (nt 3973-3993; Adams et al., 2002. J. Am. Chem. Soc., v124 p 6063) expressed from the yeast FBA1 promoter (nt 1661-2250) and followed by the FBA1 terminator (nt 4005-4317) for expression of the *Streptococcus mutans* C-terminal-tagged DHAD.

pBP4578 (SEQ ID NO:792) was constructed to contain a chimeric gene having the coding region of the ilvD gene from *Streptococcus downei* (nt position 2260-3954) expressed from the yeast FBA1 promoter (nt 1661-2250) and followed by the FBA1 terminator (nt 3966-4278) for expression of the *Streptococcus downei* DHAD with no C-terminal tag.

pBP4579 (SEQ ID NO:793) was constructed to contain a chimeric gene having the coding region of the ilvD gene from *Streptococcus downei* (nt position 2260-3954) followed by a C-terminal tag sequence (nt 3955-3975; Adams et al., 2002. J. Am. Chem. Soc., v124 p 6063) expressed from the yeast FBA1 promoter (nt 1661-2250) and followed by the FBA1 terminator (nt 3987-4299) for expression of the *Streptococcus downei* C-terminal-tagged DHAD.

pBP4580 (SEQ ID NO:794) was constructed to contain a chimeric gene having the coding region of the ilvD gene from *Oscillatoria* species PCC 6506 (nt position 2260-3942) expressed from the yeast FBA1 promoter (nt 1661-2250) and followed by the FBA1 terminator (nt 3954-4266) for expression of the *Oscillatoria* species PCC 6506 DHAD with no C-terminal tag.

pBP4581 (SEQ ID NO:795) was constructed to contain a chimeric gene having the coding region of the ilvD gene from *Oscillatoria* species PCC 6506 (nt position 2260-3942) followed by a C-terminal tag sequence (nt 3943-3963; Adams et al., 2002. J. Am. Chem. Soc., v124 p 6063) expressed from the yeast FBA1 promoter (nt 1661-2250) and followed by the FBA1 terminator (nt 3975-4287) for expression of the *Oscillatoria* species PCC 6506 C-terminal-tagged DHAD.

pBP4585 (SEQ ID NO:796) was constructed to contain a chimeric gene having the coding region of the ilvD gene from *Zea mays* (nt position 2260-3936) expressed from the yeast FBA1 promoter (nt 1661-2250) and followed by the FBA1 terminator (nt 3948-4260) for expression of the *Zea mays* DHAD with no C-terminal tag.

pBP4586 (SEQ ID NO:797) was constructed to contain a chimeric gene having the coding region of the ilvD gene from *Zea mays* (nt position 2260-3936) followed by a C-terminal tag sequence (nt 3937-3957; Adams et al., 2002. J. Am. Chem. Soc., v124 p 6063) expressed from the yeast FBA1 promoter (nt 1661-2250) and followed by the FBA1 terminator (nt 3969-4281) for expression of the *Zea mays* C-terminal-tagged DHAD.

pBP4587 (SEQ ID NO:798) was constructed to contain a chimeric gene having the coding region of the ilvD gene from *Lactococcus lactis* (nt position 2260-3969) expressed from the yeast FBA1 promoter (nt 1661-2250) and followed by the FBA1 terminator (nt 3981-4293) for expression of the *Lactococcus lactis* DHAD with no C-terminal tag.

pBP4588 (SEQ ID NO:799) was constructed to contain a chimeric gene having the coding region of the ilvD gene from *Lactococcus lactis* (nt position 2260-3969) followed by a C-terminal tag sequence (nt 3970-3990; Adams et al., 2002. J. Am. Chem. Soc., v124 p 6063) expressed from the yeast FBA1 promoter (nt 1661-2250) and followed by the FBA1 terminator (nt 4002-4314) for expression of the *Lactococcus lactis* C-terminal-tagged DHAD.

pBP4642 (SEQ ID NO:800) was constructed to contain a chimeric gene having the coding region of the ilvD gene from *Neurospora crassa* (nt position 2260-3954) expressed from the yeast FBA I promoter (nt 1661-2250) and followed by the FBA1 terminator (nt 3966-4278) for expression of the *Neurospora crassa* DHAD(1) with no C-terminal tag.

pBP4644 (SEQ ID NO:801) was constructed to contain a chimeric gene having the coding region of the ilvD gene from *Neurospora crassa* (nt position 2260-3954) followed by a C-terminal tag sequence (nt 3955-3975; Adams et al., 2002. J. Am. Chem. Soc., v124 p 6063) expressed from the yeast FBA4 promoter (nt 1661-2250) and followed by the FBA1 terminator (nt 3987-4299) for expression of the *Neurospora crassa* C-terminal-tagged DHAD(I).

pBP4643 (SEQ ID NO:802) was constructed to contain a chimeric gene having the coding region of the ilvD gene from *Neurospora crassa* (nt position 2260-3942) expressed from the yeast FBA1 promoter (nt 1661-2250) and followed by the FBA1 terminator (nt 3954-4266) for expression of the *Neurospora crassa* DHAD(2) with no C-terminal tag.

pBP4645 (SEQ ID NO:803) was constructed to contain a chimeric gene having the coding region of the ilvD gene from *Neurospora crassa* (nt position 2260-3942) followed by a C-terminal tag sequence (nt 3943-3963; Adams et al., 2002. J. Am. Chem. Soc., v124 p 6063) expressed from the yeast FBA1 promoter (nt 1661-2250) and followed by the FBA I terminator (nt 3975-4287) for expression of the *Neurospora crassa* C-terminal-tagged DHAD(2).

pBP4577 (SEQ ID NO:804) was constructed as a negative control (no heterologous DHAD expression). The *Streptococcus mutans* ilvD gene and C-terminal tag sequence in pBP1296 were removed by restriction digestion and the remaining vector was re-ligated to create pBP4577.

BY4741 fra2Δ (Thermo Scientific Open Biosystems Yeast Knock Out Clone) was transformed using a Frozen-EZ Yeast Transformation II kit (Zymo Research) and the resulting plasmids and transformants were selected on agar plates containing synthetic complete media lacking histidine supplemented with 2% glucose at 30° C. Three transformants were selected for each plasmid transformation.

DHAD Activity

Strains were grown overnight in synthetic complete media lacking histidine supplemented with 2% glucose (Teknova). Overnight cultures were sub-cultured to an optical density at a wavelength of 600 nm (OD600) of 0.25 and grown in 25 ml synthetic complete media lacking histidine supplemented with 2% glucose (Teknova) in 125 ml Erlenmeyer flat cap flasks (VWR) at 30° C. 250 revolutions per minute (RPM) in a New Brunswick I24 incubated shaker for 7.5 hours. Cultures were centrifuged at 3800×g for 5 minutes at 4° C. The pellets were washed with cold 50 mM HEPES ((4-(2-hydroxyethyl)-1-piperazineethanesulfonic acid)) pH 6.8 and then centrifuged at 3800×g for 5 minutes at 4° C. Cell pellets were frozen on dry ice and stored at −80° C. until they were assayed for DHAD activity. DHAD activity was measured as described above. All samples, except pBP1296 transformant #2, were assayed with three different volumes of cell extract; 20 µl, 40 µl, and 150 µl. pBP1296 transformant #2 was measured with 20 µl and 40 µl of cell extract.

Figure 10:
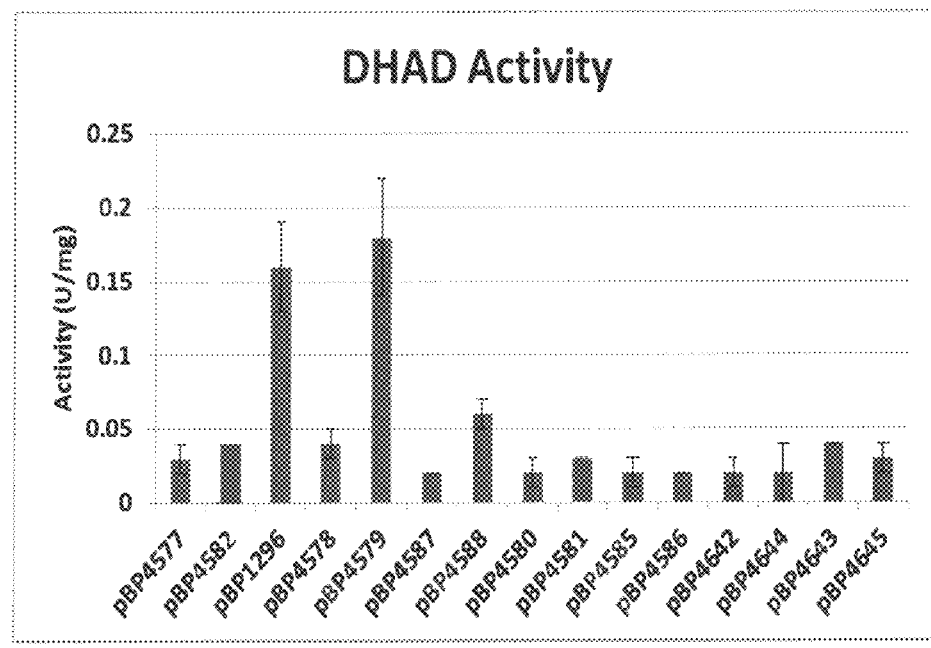
FIG. 10 is a graph illustrating DHAD activity in yeast strains expressing C-terminal-tagged or non-tagged DHAD enzymes, including C-terminal-tagged constructs for *S. mutans* DHAD, *Streptococcus downei* (*S. downei*) DHAD, and *Lactococcus lactis* (*L. lactis*) DHAD (pBP1296, pBP4579, and pBP4588, respectively).

DHAD activity is shown in FIG. 10 as units of enzyme activity per mg of total protein, with error bars reflecting the standard deviation. The DHAD activity for each DHAD construct is the average of the activities for the cell extract volumes tested and the average of the three transformants for each plasmid. The C-terminal-tagged constructs for the *Streptococcus mutans* DHAD, *Streptococcus downei* DHAD, and *Lactococcus lactis* DHAD (pBP1296, pBP4579, and pBP4588, respectively) all demonstrated higher DHAD activity than their non-C-terminal-tagged equivalents (pBP4582, pBP4578, and pBP4587, respectively). The activities for the other DHAD enzymes were too low to determine the effect of the C-terminal tag on their enzyme activities.

Example 13

Site Directed Mutagenesis to Replace Cysteines with Methionines in the C-Terminal Tag of the *S. mutans* DHAD 689-I2V5 Variant The four cysteines in the C-terminal tag of the 689-I2V5 variant of the *S. mutans* DHAD (DNA SEQ ID NO:786; protein SEQ ID NO:787) were replaced with methionines, individually and in every combination. Fifteen variants and a control were prepared via site directed mutagenesis. Mutagenesis was performed in a two-step process with the yeast shuttle plasmid pBP376. The first step entailed PCR with mutagenic primers. Primer ilvD_F1 (SEQ ID NO:805; GTG AGT ATG ACT GAC AAA AAA ACT CTT AAA GAC) and the primers listed in Table 23 were commercially synthesized by Integrated DNA Technologies, Inc. (Coralville, Iowa).

TABLE 23

| Primers Employed for Site Directed Mutagenesis | | |
|---|---|---|
| Primer | SEQ ID NO: | Sequence |
| Lum_R1 | 806 | ATT AAT CAA CCA CAG CAA CCA GGA CAA CAT TTT TTG CCA G |
| Lum_R2 | 807 | ATT AAT CAA CCA CAG CAA CCA GGA CAC ATT TTT TTG CCA G |
| Lum_R3 | 808 | ATT AAT CAA CCA CAG CAA CCA GGC ATA CAT TTT TTG CCA G |
| Lum_R4 | 809 | ATT AAT CAA CCA CAC ATA CCA GGA CAA CAT TTT TTG CCA G |
| Lum_R5 | 810 | ATT AAT CAA CCC ATG CAA CCA GGA CAA CAT TTT TTG CCA G |
| Lum_R6 | 811 | ATT AAT CAA CCA CAC ATA CCA GGA CAC ATT TTT TTG CCA G |
| Lum_R7 | 812 | ATT AAT CAA CCA CAG CAA CCA GGC ATC ATT TTT TTG CCA G |
| Lum_R8 | 813 | ATT AAT CAA CCA CAC ATA CCA GGC ATA CAT TTT TTG CCA G |
| Lum_R9 | 814 | ATT AAT CAA CCC ATG CAA CCA GGC ATA CAT TTT TTG CCA G |
| Lun_R10 | 815 | ATT AAT CAA CCC ATC ATA CCA GGA CAA CAT TTT TTG CCA G |

TABLE 23-continued

Primers Employed for Site Directed Mutagenesis

| Primer | SEQ ID NO: | Sequence |
|---|---|---|
| Lum_R11 | 816 | ATT AAT CAA CCC ATG CAA CCA GGA CAC ATT TTT TTG CCA G |
| Lum_R12 | 817 | ATT AAT CAA CCA CAC ATA CCA GGC ATC ATT TTT TTG CCA G |
| Lum_R13 | 818 | ATT AAT CAA CCC ATC ATA CCA GGC ATA CAT TTT TTG CCA G |
| Lum_R14 | 819 | ATT AAT CAA CCC ATC ATA CCA GGA CAC ATT TTT TTG CCA G |
| Lum_R15 | 820 | ATT AAT CAA CCC ATG CAA CCA GGC ATC ATT TTT TTG CCA G |
| Lum_R16 | 821 | ATT AAT CAA CCC ATC ATA CCA GGC ATC ATT TTT TTG CCA G |

Sixteen PCR reactions were performed with PFUultra polymerase (Catalog #600380; Agilent Technologies, Stratagene Products Division, La Jolla, Calif.). Each reaction consisted of 1 µl of pBP3765 (10 ng/µl), 1 µl of primer ilvD_F1 (10 uM), 1 ul of a primer listed in Table 23 (10 uM), 5 ul of 10×PFUultra buffer, 1 µl of 10 mM dNTP mix, 1 µl of PFUultra DNA polymerase, and 40 µl of ddH$_2$O. The following conditions were used for the PCR reactions: The starting temperature was 95° C. for 2.0 min followed by 30 heating/cooling cycles. Each cycle consisted of 95° C. for 30 see, 55° C. for 30 see, and 68° C. for 120 sec. At the completion of the temperature cycling, the sample was kept at 72° C. for 10.0 min more, and then held awaiting sample recovery at 4° C. The reaction products were separated from the template via agarose gel electrophoresis (1% agarose, 1× TBE buffer) and recovered using the illustra GFX PCR DNA and Gel Band Purification kit (Cat#28-9034-70, GE Healthcare Life Sciences, Piscataway, N.J.) as recommended by the manufacturer.

In the second step, the purified PCR products were employed as a megaprimers for reactions with the QuikChange® Lightning Site-Directed Mutagenesis Kit (Catalog #200523; Agilent Technologies, Stratagene Products Division, La Jolla, Calif.). Except for the primers, templates, and ddH$_2$O, all reagents used here were supplied with the kit. The reaction mixtures contained 1 µl of pBP3765 (50 ng/µl), 2.5 pd of each megaprimer (100 ng/ul), 2.5 µl of 10× reaction buffer, 0.5 µl of dNTP mix, 0.75 ul QuikSolution, 0.5 ul QuikChange Lightning Enzyme, and 17.5 µl of ddH$_2$O. The following conditions were used for the reactions: The starting temperature was 95° C. for 2 min followed by 18 heating/cooling cycles. Each cycle consisted of 95° C. for 20 sec, 60° C. for 10 see, and 68° C. for 7 min. At the completion of the temperature cycling, the samples incubated at 68° C. for 5 min and then held awaiting sample recovery at 4° C. 1 µl of the Dpn 1 (10 U/µl) was added to each reaction and the mixtures were incubated for 30 min at 37° C. Reaction products were isolated and concentrated to 6 ul with the DNA Clean & Concentrator™-5 kit (D14013; Zymo Research; Irvine, Calif.).

2.5 µl of each mutagenic reaction was transformed into One Shot® TOP10 Chemically Competent *E. coli* (Invitrogen, Catalog #C40404003) according to the manufacturer's instructions. The transformants were spread on agar plates containing the LB medium and 100 µg/ml ampicillin (Catalog #L1004, Teknova Inc. Hollister, Calif.) and incubated at 37° C. overnight. Multiple transformants for each reaction were inoculated into LB medium containing 100 µg/ml ampicillin and incubated at 37° C. with shaking at 225 rpm. Plasmid DNA was isolated from the cells with the QIAprep® Spin Miniprep Kit (Catalog #2706; Qiagen, Valencia, Calif.) according to the protocol provided by the manufacturer. Sequencing of the complete DHAD genes were performed with primers Dseq1 (aacgcgtgaagctttt-gaagatg; SEQ ID NO:822), Dseq2 (tcagttcggaacaatcacgg; SEQ ID NO:823), Dseq3 (tgctttccctttcatcaatgattgttg, SEQ ID NO:824), Dseq4 (tccatgttagccatagcgataac SEQ ID NO:825), Dseq5 (ttgtgcttcaggagcgatatg; SEQ ID NO:826), and N885 (ctgctaatgtggaattgacac, SEQ ID NO:827).

TABLE 24

Prepared Versions of the C-terminal Tag in the I2V5 Variant

| Variant | Amino Acid SEQ ID NO: | C-terminal Tag |
|---|---|---|
| YW1 (689-I2V5) | 749 | CCPGCCG |
| YW2 | 750 | MCPGCCG |
| YW3 | 751 | CMPGCCG |
| YW4 | 752 | CCPGMCG |
| YW5 | 753 | CCPGCMG |
| YW6 | 754 | MCPGMCG |
| YW7 | 755 | MMPGCCG |
| YW8 | 756 | CMPGMCG |
| YW9 | 757 | CMPGCMG |
| YW10 | 758 | CCPGMMG |
| YW11 | 759 | MCPGCMG |
| YW12 | 760 | MMPGMCG |
| YW13 | 761 | CMPGMMG |
| YW14 | 762 | MCPGMMG |
| YW15 | 763 | MMPGCMG |
| YW16 | 764 | MMPGMMG |

The variants listed in Table 24 together with 804-I2V5 variant lacking a C-terminal tag were transformed in yeast strain PNY2145 (MATa ura3Δ::loxP his3Δ pdc5Δ::P[FBA (L8)]-XPK|xpk1_Lp-CYCt-loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66 amn1Δ::AMN1(y); described, for example, in Int'l Appl. No. PCT/US2012/072186, filed Dec. 28, 2012, which is incorporated by reference herein) and analyzed for isobutanol production and DHAD activity.

Growth Media

Four types of media were used during the growth procedure of yeast strains: SE-ura agar plate, SAG-2-ura agar plate, an aerobic pre-culture media and an anaerobic culture media. All chemicals were obtained from Sigma-Aldrich® (St. Louis, Mo.) unless otherwise noted.

Yeast transformation recovery plate (SE-ura): 50 mM 2-(N-morpholino)ethanesulfonic acid (MES) (pH 5.5), 6.7 g/L yeast nitrogen base without amino acids (Difco™, 291940, Sparks, Md.), 1.4 g/L yeast synthetic drop-out medium supplement without histidine, leucine, tryptophan and uracil, 0.2% ethanol, 0.01% weight per volume (w/v) leucine, 0.01% w/v histidine, and 0.002% w/v tryptophan.

Glucose adaptation plate (SAG-2-Ura): 50 mM MES (pH 5.5, 6.7 g/L yeast nitrogen base without amino acids (Difco™, 291940, Sparks, Md.), 1.4 g/L yeast synthetic drop-out medium supplement without histidine, leucine, tryptophan and uracil, 3 mM sodium acetate (pH 7.0), 2% w/v glucose, 0.01% w/v leucine, 0.01% w/v histidine, and 0.002% w/v tryptophan.

Aerobic pre-culture media (SAG-0.2-Ura): 6.7 g/L yeast nitrogen base without amino acids (Difco™, 291940, Sparks, Md.), 1.4 g/L yeast synthetic drop-out medium supplement without histidine, leucine, tryptophan and uracil, 3 mM sodium acetate (pH 7.0), 0.2% w/v glucose, 0.01% w/v leucine, 0.01% w/v histidine, and 0.002% w/v tryptophan.

Anaerobic culture media (SAG-3-Ura): 50 mM MES (pH 5.5, 6.7 g/L yeast nitrogen base without amino acids (Difco™, 291940, Sparks, Md.), 1.4 g/L yeast synthetic drop-out medium supplement without histidine, leucine, tryptophan and uracil, 3 mM sodium acetate (pH 7.0), 3% w/v glucose, 0.01% w/v leucine, 0.01% w/v histidine, 0.002% w/v tryptophan, 30 mg/L nicotinic acid, 30 mg/L thiamine and 10 mg/L ergosterol made up in 50/50 volume per volume (v/v) Tween/ethanol solution.

Transformation and Glucose Adaptation

Competent cells of the PNY2145 were prepared and transformed with 1 µL of purified plasmid (~0.4 to 0.8 µg total DNA) using a Frozen-EZ Yeast Transformation II Kit™ (Zymo Research Corp.; Irvine, Calif.). Transformation mixtures were plated on SE-ura plates and incubated at 30° C. for 4 days. Three or four colonies for each transformant were selected and patched onto SE-ura plates and incubated at 30° C. for 2 days. The variants then underwent glucose adaptation by patching onto SAG-2-Ura plates and growing for 2 days at 30° C.

Deep-Well Plate Growth Procedure 1.5 mL aliquots of the aerobic pre-culture media were dispensed into each well of a VWR 48 deep-well plate (#82004-674, VWR, Radnor, Pa.) and inoculated with cells grown on a SAG-2-Ura agar plate, as described above. A sterile air permeable cover (#60941-086, VWR, Radnor, Pa.) was used to seal the culture plate. The plate was placed in a 30° C. incubator and was grown for 20 to 24 hours with shaking, and an OD600 value (optical density at 600 nm) was obtained using Spectra Max384 Plus plate reader (Molecular Devices, Sunnyvale, Calif.). OD600 values were converted to equivalent OD600 values on a Cary 300 (Agilent Technologies, Wilmington, Del.) calibration value. A dilution 48 deep-well plate was set with a target Cary OD600 value of 0.35 for each well in a total volume of 1.5 mL. Wells with Cary OD600 values of 0.35 to 0.40 were transferred directly from the original plate to the dilution plate. For all other wells, a volume of turbid culture was transferred the volume was brought up to 1.5 mL with aerobic pre-culture media. The 48 deep-well plate was returned to the 30° C. shaking incubator and grown for an additional 20 to 24 hours. OD600 values were obtained as described above.

Isobutanol Titers and DHAD Activities

Figure 11:
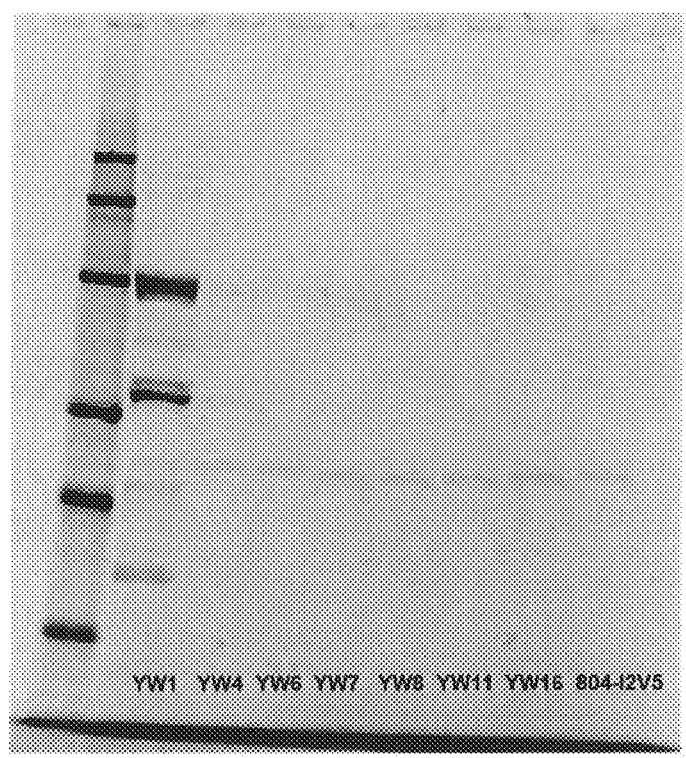
FIG. 11 is a gel image showing tag detection for selected DHAD variants as described in the examples.

PNY2145 with *S. mutans* DHAD variants were grown and analyzed as described above. Additionally, the resultant cells were pelleted via centrifugation and the DHAD activities were measured as described above. Isobutanol titers and DHAD specific activities are listed in Table 25 below. FIG. 11 shows gel analysis for selected variants to determine whether these proteins are detected with the Lumio™ reagent. The gel was prepared was prepared as described in Example 14. Only lanes for variants YW1, YW4, and YW7 contain bands consistent with detected DHAD protein. The lane 804-I2V5 represents the negative control lacking a c-terminal tag.

TABLE 25

Isobutanol titers and DHAD specific activities for *S. mutans* DHAD variants in PNY2145

| Variant | C-terminal Tag | Isobutanol mM at 44 hr | | DHAD SA (U/mg) | |
|---|---|---|---|---|---|
| | | Mean | SD | Mean | SD |
| YW1 (689-I2V5) | CCPGCCG | 82.1 | 3.9 | 1.06 | 0.09 |
| YW2 | MCPGCCG | 73.5 | 5.7 | 0.81 | 0.09 |
| YW3 | CMPGCCG | 78.0 | 4.5 | 0.76 | 0.04 |
| YW4 | CCPGMCG | 76.6 | 5.3 | 0.39 | 0.33 |
| YW5 | CCPGCMG | 74.6 | 4.3 | 0.99 | 0.13 |
| YW6 | MCPGMCG | 59.1 | 5.0 | 0.16 | 0.19 |
| YW7 | MMPGCCG | 65.9 | 6.6 | 0.41 | 0.07 |
| YW8 | CMPGMCG | 57.0 | 4.7 | 0.29 | 0.10 |
| YW9 | CMPGCMG | 50.5 | 3.4 | 0.33 | 0.04 |
| YW10 | CCPGMMG | 57.9 | 1.1 | 0.30 | 0.06 |
| YW11 | MCPGCMG | 70.0 | 3.2 | 0.47 | 0.17 |
| YW12 | MMPGMCG | 39.3 | 2.0 | 0.28 | 0.13 |
| YW13 | CMPGMMG | 43.0 | 3.4 | 0.22 | 0.13 |
| YW14 | MCPGMMG | 44.9 | 4.5 | 0.19 | 0.07 |
| YW15 | MMPGCMG | 44.7 | 3.7 | 0.21 | 0.02 |
| YW16 | MMPGMMG | 39.1 | 1.6 | 0.22 | 0.02 |
| 804-I2V5 | No tag | 38.3 | 6.6 | 0.14 | 0.06 |

Example 14

Construction of DHAD-C-Terminal Tag Variants

Eight C-terminal tag variants containing either amino acid changes or additions were constructed by PCR amplification of the native sequence from the plasmid pBP3765 (SEQ ID NO:828). One forward primer N1560 was used with eight reverse primers N1561, N1562, N1563, N1564, N1565, N1566, N1567 and N1568. The resulting PCR products were cloned into a TOPO vector (Invitrogen Cat. No. K288020) and sequenced to verify the engineered nucleotide changes.

Construction of ilvD-I2V5-C-Terminal Tag Plasmids

The TOPO-clones containing the PCR products described above were restriction digested with AscI and PacI and ligated to the AscI and PacI digested plasmid pBP3765 thus replacing the 3' end of the ilvD-I2V5-Lum. The ligation reaction was transformed into *E. coli* Stbl3 cells (Invitrogen Cat. No. C737303) which were incubated on LB ampicillin plates to select for transformants. Successful insertion was identified by PCR colony screen using PCR primers N1576 and N1577. Colonies screening positive for an insertion were cultivated, plasmids isolated and the C-terminal tag locus sequenced for final verification of engineered nucleotide changes. The plasmids were designated, respectively: pJT386, pJT387, pJT388, pJT389, pJT390, pJT391, pJT392, and pJT39.

TABLE 26

C-terminal tag amino acid sequences and corresponding expression plasmids

| Control: | CCPGCCG (SEQ ID NO: 748) | pBP3765 |
|---|---|---|
| Variant 1: | CSCPGCCG (SEQ ID NO: 739) | pJT386 |
| Variant 2: | CPCPGCCG (SEQ ID NO: 740) | pJT387 |
| Variant 3: | CECPGCCG (SEQ ID NO: 741) | pJT388 |
| Variant 4: | CCPGCSCG (SEQ ID NO: 742) | pJT389 |

TABLE 26-continued

C-terminal tag amino acid sequences and corresponding expression plasmids

| | | |
|---|---|---|
| Variant 5: | CCPGCPCG (SEQ ID NO: 743) | pJT390 |
| Variant 6: | CCPGCECG (SEQ ID NO: 744) | pJT391 |
| Variant 7: | CCPEGCCG (SEQ ID NO: 745) | pJT392 |
| Variant 8: | CCPAGCCG (SEQ ID NO: 746) | pJT393 |

Construction of Isobutanologen Strains with C-Terminal Tag Variant DHAD Enzymes

The plasmids above (plus control) were each transformed along with pRS413::BiADH-kivD into strain PNY2145. Transformation mixtures were plated on synthetic complete medium without uracil or histidine containing 1% ethanol as carbon source. Cells from transformant colonies were patched to fresh plates. After two days, cells from patches were transferred to plates containing 2% glucose instead of ethanol as carbon source. After two days, cells from patches were used to inoculate liquid medium (synthetic complete without uracil or histidine with 0.3% glucose). The next morning, the optical density of each culture was adjusted with fresh medium. After approximately 4 hours, cultures were used to inoculate 15 mL serum vials containing synthetic complete medium minus uracil and histidine with 2% glucose as carbon source and supplemented with 1×BME vitamins (Sigma Cat. No. B6891). The starting OD for each culture was 0.1 and the final volume was 10 mL. Vials were stoppered, crimped and incubated at 30° C. in an Infors Multitron platform shaker (220 rpm). After 38.5 hours, stoppers were removed for sampling. Culture supernatant obtained from Costar Spin-X columns (3,000 rpm, 3 minutes) was analyzed by HPLC, as described in Example 4. Concentration of isobutanol was determined using a standard curve. Glucose consumption was also calculated by standard curve. A second series of serum vial cultures was set up as described above with one clone from each genotype. This time cells were collected from the cultures 24 hours after inoculation (3 minutes, 500×g). Cell pellets were then stored at −80° C. DHAD assay as described in the Examples herein or as described by Flint and Emptage (J. Biol. Chem., 263(8):3558-64, 1988) using dinitrophenylhydrazine.

Table 27 shows the glucose consumption and isobutanol concentration from 39 hour serum vial incubation. For all variants except variant #6, there were n=3 biological replicates. For variant #6, there were n=2 biological replicates and for the control, n=2 technical replicates. The DHAD specific activity from 24 hour serum vial incubation is one individual clone of each variant.

TABLE 27

Glucose consumption and isobutanol concentration from 39 hour serum vial incubation

| C-terminal Tag Variant | Glucose Consumed (mM) | Isobutanol concentration (mM) | Representative DHAD Specific Activity (μmole/min/mg) |
|---|---|---|---|
| 1 | 81.2 ± 1.8 | 53.7 ± 1.7 | 0.85 |
| 2 | 88.4 ± 6.0 | 59.4 ± 3.3 | 0.89 |
| 3 | 88.9 ± 1.9 | 60.0 ± 1.0 | 1.06 |
| 4 | 86.3 ± 7.8 | 57.2 ± 3.7 | 1.2 |
| 5 | 81.4 ± 1.6 | 54.2 ± 1.0 | 1.2 |
| 6 | 87.2 ± 0.4 | 57.9 ± 0.4 | 1.1 |
| 7 | 86.4 ± 2.3 | 57.2 ± 1.4 | 1.51 |
| 8 | 84.4 ± 6.9 | 55.8 ± 4.4 | 1.93 |
| Control | 95.8 ± 0.5 | 64.4 ± 0.7 | 1.47 |

Sequences were detected using the Lumio™ Green Detection kit (LC6090, Invitrogen Life Technologies, Carlsbad, Calif.) according to the manufacturer's instructions, with the following modifications. The buffer used to lyse the cells was a HEPES buffer, pH 6.8. A master mix combining 60 μL of 4× Lumio™ Gel Sample buffer and 2.4 μL of Lumio™ Green Detection reagent was made; each sample received a 5.2 μL aliquot of this master mix. Cell lysates were concentrated approximately 3 to 4 fold using a YM-10 spin filter prior to the addition of the master mix.

Figure 12:
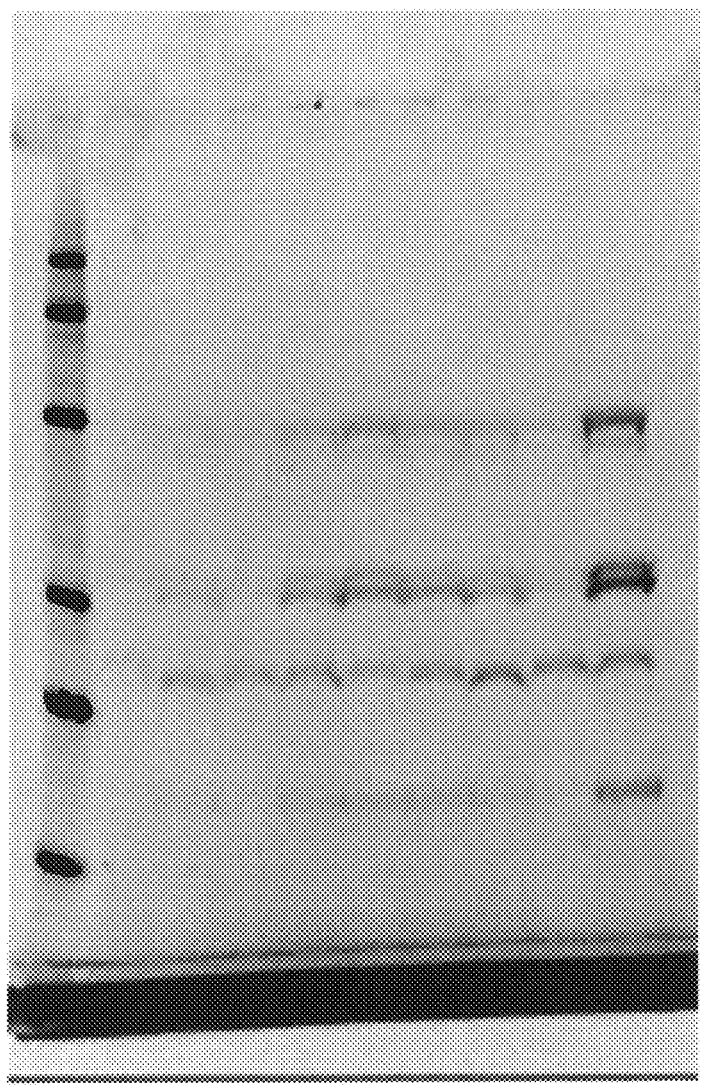
FIG. 12 is a gel image showing tag detection for selected DHAD variants as described in the examples.
Figure 13:
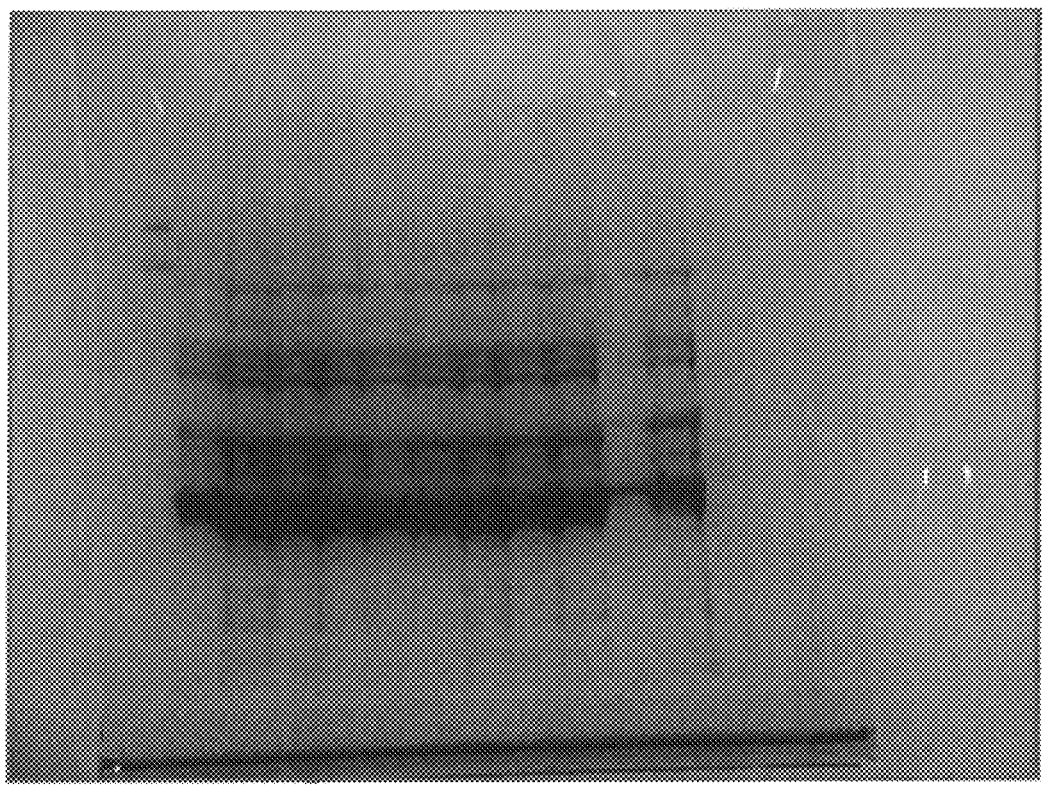
FIG. 13 is a protein stained gel for selected DHAD variants as described in the examples.

A 10% Bis-Tris gel (NP0303, Invitrogen, Carlsbad, Calif.) was run in 1×MOPS buffer (NP000102, Invitrogen, Carlsbad, Calif.) at 185V for 50 minutes. A BioRad Gel Doc (BioRad, Hercules, Calif.) system was used to visualize and image the gel, according to the Lumio™ Green Detection kit instructions (FIG. 12). The lanes of the gel in FIG. 12 are as follows: 1. Lumio™ Molecular Weight Marker; 2. pJT386; 3. pJT387; 4. pJT388; 5. pJT389; 6. pJT390; 7. pJT391; 8. pJT392; 9. pJT393; and 10. PNY2312 (positive control). After the gel image was acquired, the gel was stained following the Simple Blue (LC6060, Invitrogen, Carlsbad, Calif.) protocol in order to visualize total protein (FIG. 13). The lanes of the gel in FIG. 13 are as follows: 1. Lumio™ Molecular Weight Marker; 2. pJT386; 3. pJT387; 4. pJT388; 5. pJT389; 6. pJT390; 7. pJT391; 8. pJT392; 9. pJT393; 10. PNY2312 (positive control); 11. PNY2145+pLH804; and 12. PNY2145+PLH804 L2V4 #1. Analysis of gel image was performed using Image Lab 4.0 (BioRad, Hercules, Calif.) to quantitate the signal, with the arrow indicating the DHAD reference band (Table 28).

TABLE 28

Relative Quantity of signal

| Lane | Relative Quantity |
|---|---|
| 1 | n/d |
| 2 | n/d |
| 3 | n/d |
| 4 | 0.24 |
| 5 | 0.38 |
| 6 | 0.25 |
| 7 | 0.28 |
| 8 | 0.16 |
| C | 1.00 |

Example 15 ilvD_Sm with C-Terminal Tag Variants in Isobutanologen

Plasmid Construction

Plasmids were constructed in a 2-micron based *Saccharomyces cerevisiae-Escherichia coli* shuttle vector.

TABLE 29

Plasmids referenced in Example 15

| Plasmid | DHAD description | C-terminal Amino Acid Sequence |
|---|---|---|
| BP3763 | Full-length | Lys-Lys-Cterm |
| pBP3765 | tag | Lys-Lys-Cys-Cvs-Pro-Gly-Cys-Cys-Gly-Cterm |
| pBP3767 | tag 2C-2A | Lys-Lys-Cys-Ala-Pro-Gly-Ala-Cys-Gly-Cterm |
| pBP3769 | tag 2C-2S | Lys-Lys-Cys-Ser-Pro-Gly-Ser-Cys-Gly-Cterm |
| pBP3771 | Tag 4C-2A2S | Lys-Lys-Ser-Ala-Pro-Gly-Ala-Ser-Gly-Cterm | pBP3763—Native Length ilvD_Sm pBP3763 (SEQ ID NO:850) was constructed to contain a chimeric gene having the coding region of the *Streptococcus mutans* ilvD variant I2V5 (nucleotide (nt) position 5356-3644) expressed from the yeast TEF1 mutant 7 promoter (nt 5766-5366; Nevoigt et al., Applied and Environmental Microbiology, 72:5266, 2006) and followed by the FBA1 terminator (nt 3632-3320) for expression of DHAD, and a chimeric gene having the coding region of *Anaerostipes cacae* ilvC variant K9JB4P (nt 1628-2659; described in WO2012/12955, incorporated herein by reference) expressed from the yeast ILV5 promoter (nt 434-1614) and followed by the ILV5 terminator (nt 2673-3307) for expression of ketol-acid reductoisomerase (KARI).

pBP3765—C-Terminal Tagged ilvD_Sm pBP3765 (SEQ ID NO:828) was constructed to contain a chimeric gene having the coding region of the *Streptococcus mutans* ilvD variant I2V5 (nt position 5377-3665) followed by a C-terminal tag sequence (nt 3664-3647; Adams et al., J. Am. Chem. Soc., 124:6063, 2002) expressed from the yeast TEF1 mutant 7 promoter (nt 5787-5387; Nevoigt et al., Applied and Environmental Microbiology, 72:5266, 2006), and followed by the FBA1 terminator (nt 3632-3320) for expression of DHAD, and a chimeric gene having the coding region of the *Anaerostipes cacae* ilvC variant K9JB4P (nt 1628-2659; described in, for example, Int'l Publ. No. WO2012/12955, which is incorporated by reference herein) expressed from the yeast ILV5 promoter (nt 434-1614) and followed by the ILV5 terminator (nt 2673-3307) for expression of KARI.

pBP3767—2C-2A Variant C-Terminal Tagged ilvD_Sm pBP3767 (SEQ ID NO:851) was constructed to contain a chimeric gene having the coding region of the *Streptococcus mutans* ilvD variant I2V5 (nt position 5377-3665) followed by the 2C-2A C-terminal tag sequence (nt 3664-3647) expressed from the yeast TEF1 mutant 7 promoter (nt 5787-5387; Nevoigt et al., Applied and Environmental Microbiology, 72:5266, 2006), and followed by the FBA1 terminator (nt 3632-3320) for expression of DHAD, and a chimeric gene having the coding region of the *Anaerostipes cacae* ilvC variant K9JB4P (nt 1628-2659; described in, for example, Int'l Pub. No. WO2012/12955, which is incorporated by reference herein) expressed from the yeast ILV5 promoter (nt 434-1614) and followed by the ILV5 terminator (nt 2673-3307) for expression of KARL.

pBP3769—2C-2S variant C-terminal Tagged ilvD_Sm pBP3769 (SEQ ID NO:852) was constructed to contain a chimeric gene having the coding region of the *Streptococcus mutans* ilvD variant I2V5 (nt position 5377-3665) followed by the 2C-2S C-terminal tag sequence (nt 3664-3647) expressed from the yeast TEF1 mutant 7 promoter (nt 5787-5387; Nevoigt et al., Applied and Environmental Microbiology, 72:5266, 2006), and followed by the FBA1 terminator (nt 3632-3320) for expression of DHAD, and a chimeric gene having the coding region of the *Anaerostipes cacae* ilvC variant K9JB4P (nt 1628-2659; described in, for example, Int'l Pub. No. WO2012/12955, which is incorporated by reference herein) expressed from the yeast ILV5 promoter (nt 434-1614) and followed by the ILV5 terminator (nt 2673-3307) for expression of KARI.

pBP3771—4C-2A2S Variant C-Terminal Tagged ilvD_Sm pBP3771 (SEQ ID NO:853) was constructed to contain a chimeric gene having the coding region of the *Streptococcus mutans* ilvD variant I2V5 (nt position 5377-3665) followed by the 4C-2A2S C-terminal tag sequence (nt 3664-3647) expressed from the yeast TEF1 mutant 7 promoter (nt 5787-5387; Nevoigt et al., Applied and Environmental Microbiology, 72:5266, 2006), and followed by the FBA1 terminator (nt 3632-3320) for expression of DHAD, and a chimeric gene having the coding region of the *Anaerostipes cacae* ilvC variant K9JB4P (nt 1628-2659; described in, for example, Int'l Pub. No. WO2012/12955, which is incorporated by reference herein) expressed from the yeast ILV5 promoter (nt 434-1614) and followed by the ILV5 terminator (nt 2673-3307) for expression of KARI.

Strain Construction

Following conversion of PNY2115 to PNY2121 by replacing the endogenous copy of AMN1 with a codon-optimized version of the AMN1 gene from CEN.PK2 (SEQ ID NO:854), PNY2121 was restored back to a histidine prototroph. The HIS3 coding sequence and 500 bp upstream and downstream of the coding sequence were amplified from a haploid (PNY0865) obtained from sporulation of PNY0827. PNY2121 was transformed with the resulting PCR product and transformants were selected on agar plates containing synthetic complete media lacking histidine supplemented with 1% ethanol at 30° C. A PNY2121 HIS3+ isolate was designated PNY1665.

PNY1665 was transformed with the plasmids described above and transformants were selected on agar plates containing synthetic complete media lacking uracil supplemented with 1% ethanol at 30° C. Three transformants were selected for each plasmid construct.

DHAD Activity

Strains were grown overnight in 12 ml of low glucose medium in 125 ml VWR vent cap shake flasks at 30° C. at 250 RPM in a New Brunswick I24 incubated shaker. The low glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.2% w/v ethanol, 0.3% w/v glucose, 100 mM 2-Morpholinoethanesulphonic acid (MES) buffer, adjusted to pH 5.5 with KOH. Overnight cultures were sub-cultured into 15 ml of high glucose medium in 125 ml VWR vent cap shake flasks to a final OD600 0.4 and grown for 4 hours at 30° C. at 250 RPM in a New Brunswick I24 incubated shaker. The high glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.2% w/v ethanol, 3.0% w/v glucose, 100 mM 2-Morpholinoethanesulphonic acid (MES)

buffer, adjusted to pH 5.5 with KOH. Cells were centrifuged at 3800×g for 5 minutes at room temperature and cell pellets were resuspended in 2 ml of high glucose medium. 30 ml of high glucose medium in 60 ml serum vials (Kimble Chase; Vineland, N.J.) was inoculated with resuspended cells to a final OD600 of 0.2. Serum vials were sealed and cultures were grown at 30° C. at 250 RPM in a New Brunswick I24 incubated shaker for 24 hours. Cultures were centrifuged at 3800×g for 5 minutes at 4° C. The pellets were washed with cold 50 mM HEPES pH 6.8 and then centrifuged at 3800×g for 5 minutes at 4° C. Cell pellets were frozen on dry ice and stored at −80° C. until they were assayed for DHAD activity. DHAD activity was measured as described above.

Strains containing the tagged ilvD_Sm plasmid (pBP3765) had an average DHAD activity of 0.68 (U/mg) (Table 30). Strains containing the plasmids with the C-terminal tag variants (pBP3767, pBP3769, pBP3771) had DHAD activities similar to the strains containing the native length ilvD_Sm plasmid (pBP3763); average DHAD activities ranging from of 0.11 to 0.16 (U/mg).

TABLE 30

Average DHAD activity and standard deviation for three transformants

| Plasmid | DHAD description | DHAD Activity (U/mg) |
| --- | --- | --- |
| pBP3763 | Full-length | 0.14 ± 0.02 |
| PBP3765 | tag | 0.68 ± 0.05 |
| pBP3767 | tag 2C-2A | 0.15 ± 0.04 |
| pBP3769 | tag 2C-2S | 0.16 ± 0.03 |
| pBP3771 | tag 4C-2A2S | 0.11 ± 0.04 |

Example 16

C-Terminal-Tagged ilvD_Sm in Isobutanol Production

Isobutanol production was tested for isobutanologen strains. PNY1604, PNY1614, PNY1602, and PNY1612 were grown overnight in 10 ml of low glucose medium in 125 ml VWR vent cap shake flasks at 30° C. at 250 RPM in a New Brunswick I24 incubated shaker. The low glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.2% w/v ethanol, 0.3% w/v glucose, 100 mM 2-Morpholinoethanesulphonic acid (MES) buffer, adjusted to pH 5.5 with KOH. Overnight cultures were centrifuged at 3800×g for 5 minutes at room temperature and cell pellets were resuspended in 2 ml of high glucose medium. High glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.1% w/v ethanol, 3.0% w/v glucose, 100 mM 2-Morpholinoethanesulphonic acid (MES) buffer, adjusted to pH 5.5 with KOH. 10 ml of high glucose medium in 125 ml VWR vent cap shake flasks was inoculated with cells to a final OD600 0.4 and grown for 5 hours at 30° C. at 250 RPM in a New Brunswick I24 incubated shaker. Cells were centrifuged at 3800×g for 5 minutes at room temperature and cell pellets were resuspended in high glucose medium to an OD600 0.2. 10 ml of the culture in high glucose medium was transferred to a 20 ml serum vial (Kimble Chase; Vineland, N.J.). Serum vials were sealed and cultures were grown at 30° C. at 250 RPM in a New Brunswick I24 incubated shaker for 42 hours.

After 42 hours, the cultures were sampled for OD600 and culture supernatants (collected using Spin-X centrifuge tube filter units, Costar Cat. No. 8169) were analyzed by HPLC (as described in Example 4). OD600, isobutanol concentration, and isobutanol molar yield are presented in Table 31.

TABLE 31

Average OD600, isobutanol concentration, and isobutanol molar yield and standard deviations

| Strain | OD600 | Isobutanol (mM) | Isobutanol yield (mol/mol) |
| --- | --- | --- | --- |
| PNY1604/PNY1614 (control) | 1.5 ± 0.1 | 81.8 ± 1.9 | 0.60 ± 0.00 |
| PNY1602/PNY1612 (tagged) | 2.1 ± 0.1 | 102.5 ± 3.1 | 0.62 ± 0.02 |

Example 17

S. mutans DHAD and S. macacae DHAD

Plasmid and Strain Construction

Plasmids were constructed in the 2-micron Saccharomyces cerevisiae-Escherichia coli shuttle vector pHR81 (SEQ ID NO:855; ATCC 87541).

pBP5062 (SEQ ID NO:856) was constructed to contain a chimeric gene having the coding region of the ilvD gene from Streptococcus mutans (nt position 9644-11356) expressed from the yeast FBA1 promoter (nt 8639-9636) and followed by the FBA1 terminator (nt 7-1006) for expression of the Streptococcus mutans DHAD.

pBP5063 (SEQ ID NO:857) was constructed to contain a chimeric gene having the coding region of the ilvD gene from Streptococcus macacae codon optimized for expression in Saccharomyces cerevisiae (nt position 9644-11356) expressed from the yeast FBA1 promoter (nt 8639-9636) and followed by the FBA1 terminator (nt 7-1006) for expression of the Streptococcus macacae DHAD.

BY4741 (ATCC 201388) and BY4741 fra2Δ (Thermo Scientific Open Biosystems Yeast Knock Out Clone) were transformed using a Frozen-EZ Yeast Transformation II kit (Zymo Research) with pHR81, pBP5062, and pBP5063 and transformants were selected on agar plates containing synthetic complete media lacking uracil supplemented with 2% glucose at 30° C. Three transformants were selected for each plasmid transformation.

DHAD Activity

Strains were grown overnight in synthetic complete media lacking uracil supplemented with 2% glucose (Teknova). Overnight cultures were sub-cultured to an OD600 0.4 and grown in 25 ml synthetic complete media lacking uracil supplemented with 2% glucose (Teknova) in 250 ml Erlenmeyer vent cap flasks (VWR) at 30° C. 250 RPM in a New Brunswick I24 incubated shaker for 5.5 hours. Cultures were centrifuged at 3800×g for 5 minutes at 4° C. The pellets were washed with cold 50 mM HEPES pH 6.8 and then centrifuged at 3800×g for 5 minutes at 4° C. Cell pellets were frozen on dry ice and stored at −80° C. until they were assayed for DHAD activity.

For DHAD activity measurements the frozen yeast cells were thawed, resuspended in 0.1 M K-Hepes pH 6.8 containing 10 mM MgCl2 and a protease inhibitor cocktail (Roche, Catalog #11873580001), and then broken by bead beating. The broken cells were centrifuged to remove the cell debris and generate the yeast crude extract. Protein concentrations (mg/ml) of extracts were measured with the Pierce Coomassie Plus (Bradford) Protein Assay (Catalog #23236, Thermoscientific). DHAD enzyme activities were measured spectrophotometrically in an end point assay using the 2,4-dinitrophenylhydrazine (2,4-DNPH) method as described in Flint, D. H. and M. H. Emptage, J. Biol. Chem. 263:3558-64, 1988, with modifications. The assay buffer contained 0.1 M Tris pH 8.0, 10 mM MgCl2, and 0.5 mM TPP. Yeast extracts were diluted in assay buffer. Sufficient (R)-2,3-dihydroxyisovaleric acid was added to assay buffer so that the final concentration in the assay was 10 mM. In each assay, an enzyme containing solution and sufficient substrate containing buffer were mixed so that the final volume was 300 ul. Assay mixtures were incubated at 37° C. for 20 minutes. At five minute intervals, a 60 ul aliquot of each reaction was mixed with 70 ul of a saturated solution of 2,4-DNPH in 1 N HCl. Following a 30 minute incubation at room temperature, 70 ul of 4 N KOH in ethanol was then added to the solution, followed by brief mixing. The absorbance of the mixture was read at 540 nm with a Spectra Max384 Plus plate reader (Molecular Devices, Sunnyvale, Calif.). A standard curve containing 0 mM to 1.33 mM α-ketoisovalerate was employed to calculate enzyme activities (units per milliliter, U/ml) for the conversion of (R)-2,3-dihydroxyvalerate to α-ketoisovalerate in the assays. DHAD specific activities (units per milligram, U/mg) were determined from enzyme activities (U/ml) and protein concentrations (mg/ml) measured for each sample.

Figure 14:
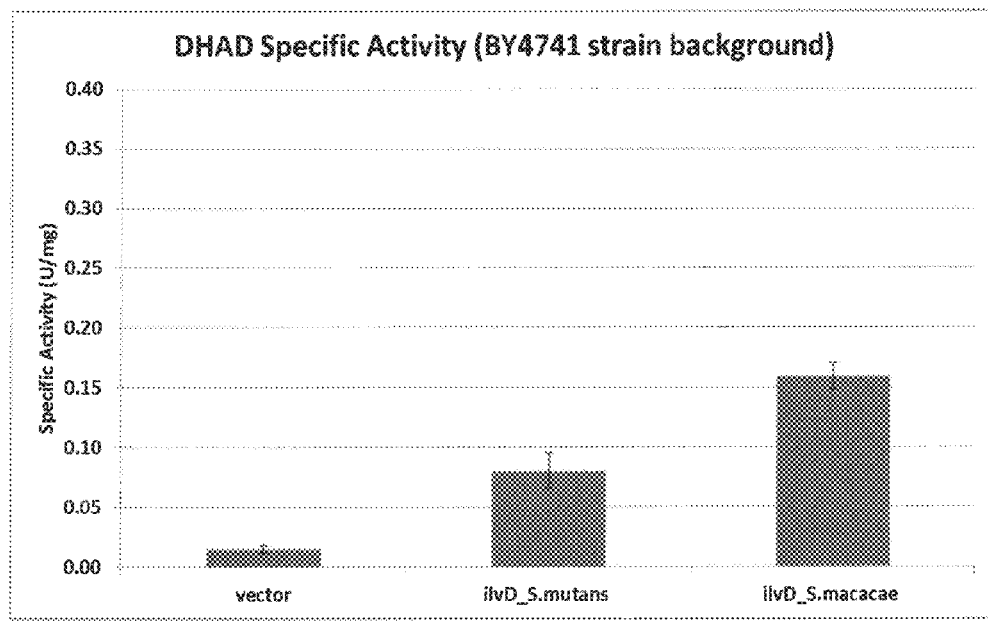
FIG. 14 is a graph illustrating the specific activity of DHAD ilvD_*S. mutans* and DHAD ilvD *Streptococcus macacae* (*S. macacae*) in a BY4741 strain background.
Figure 15:
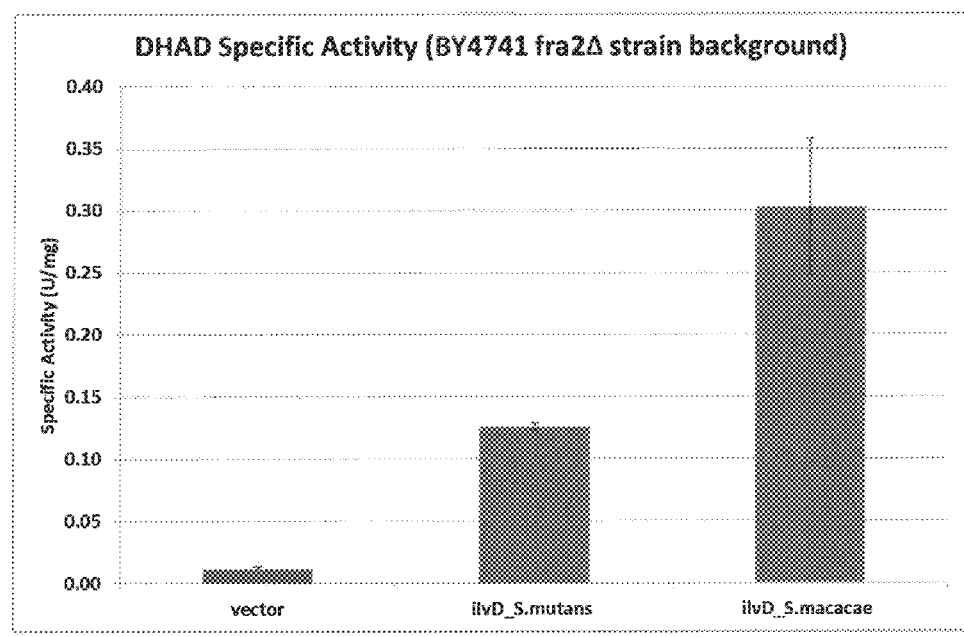
FIG. 15 is a graph illustrating the specific activity of DHAD ilvD_*S. mutans* and DHAD ilvD *S. macacae* in a BY4741 fra2Δ strain background.

DHAD activities are shown in FIG. 14 for the BY4741 strain background and in FIG. 15 for the BY4741fra2Δ strain background for control vector-transformations ("vector"), for *S. mutans* ilvD ("ilvD_S.mutans"), and *S. macacae* ilvD ("ilvD_S.macacae"). The DHAD activity for each construct is the average of the activities for the three transformants for each plasmid.

Example 18

Plasmid Construction for Expression of C-Terminal Deletion Variants of Dehydroxy-Acid Dehydratase (DHAD)

The following table provides the genotypes of the various yeast strains referenced in the following Examples.

TABLE 32

Strain names and genotypes

| Strain Name | Genotype |
| --- | --- |
| PNY2115 | MATa ura3Δ::loxP his3Δ pdc5Δ::loxP66/71 2-micron plasmid (CEN.PK2) pdc1 Δ::P[PDC1]-ALS\|alsS_Bs-CYC1t-loxP71/66 pdc6Δ::(UAS)PGK1-P[FBA1]-KIVD\|Lg(y)-TDH3t-loxP71/66 adh1Δ::P[ADH1]-ADH\|Bi(y)-ADHt-loxP71/66 fra2Δ::P[ILV5]-ADH\|Bi(y)-ADHt-loxP71/66 gpd2Δ::loxP71/66 |
| PNY1566 | MATa ura3Δ::loxP pdc5Δ::loxP66/71 2-micron plasmid (CEN.PK2) pdc1Δ::P[PDC1]-ALS\|alsS_Bs-CYC1t-loxP71/66 pdc6Δ::(UAS)PGK1-P[FBA1]-KIVD\|Lg(y)-TDH3t-loxP71/66 adh1Δ::P[ADH1]-ADH\|Bi(y)-ADHt-loxP71/66 fra2Δ::P[ILV5]-ADH\|Bi(y)-ADHt-loxP71/66 gpd2Δ::loxP71/66 |

TABLE 32-continued

Strain names and genotypes

| Strain Name | Genotype |
| --- | --- |
| PNY1603 and PNY1613 | PNY1566 with plasmid pLH691 containing (P[ILV5]-KARI\|ilvC_Ll-ILV5t P[TEF1(M7)]-DHAD\|ilvD_Sm_Δ9-FBA1t) |
| PNY1604 and PNY1614 | PNY1566 with plasmid pLH804 containing (P[ILV5]-KARI\|ilvC_Ll-ILV5t P[TEF1(M7)]-DHAD\|ilvD_Sm-FBA1t) |

Plasmids were constructed in a 2-micron based *Saccharomyces cerevisiae-Escherichia coli* shuttle vector.

pLH804—ilvD_Sm pLH804 (SEQ ID NO:591) was constructed to contain a chimeric gene having the coding region of the ilvD gene from *Streptococcus mutans* (nucleotide (nt) position 5356-3644) expressed from the yeast TEF1 mutant 7 promoter (nt 5766-5366; Nevoigt et al., Applied and Environmental Microbiology, 72:5266, 2006) and followed by the FBA1 terminator (nt 3632-3320) for expression of DHAD, and a chimeric gene having the coding region of the K9JB4P mutant ilvC gene from *Anaeropstipes cacae* (nt 1628-2659) expressed from the yeast ILV5 promoter (nt 434-1614) and followed by the ILV5 terminator (nt 2673-3307) for expression of ketol-acid reductoisomerase (KARI), described, for example, in PCT App. Pub. No. WO2012/12955, which is incorporated by reference herein.

pLH691—ilvD_Sm Δ9 pLH691 (SEQ ID NO:590) was constructed to contain a chimeric gene having the coding region of the ilvD gene from *Streptococcus mutans* (nt position 5329-3644) with the C-terminal 9 amino acids deleted, expressed from the yeast TEF1 mutant 7 promoter (nt 5739-5339; Nevoigt et al., Applied and Environmental Microbiology, 72:5266, 2006), and followed by the FBA1 terminator (nt 3632-3320) for expression of DHAD, and a chimeric gene having the coding region of the *Anaerostipes caccae* ilvC variant K9JB4P (nt 1628-2659) expressed from the yeast ILV5 promoter (nt 434-1614) and followed by the ILV5 terminator (nt 2673-3307) for expression of KARI.

Example 19

Construction of Yeast Strains PNY1566, PNY1603 PNY1 604, PNY1613, and PNY1614

To obtain PNY0865, PNY0827 was sporulated using standard methods (Codón A C, Gasent-Ramírez J M, Benítez T. Factors which affect the frequency of sporulation and tetrad formation in *Saccharomyces cerevisiae* baker's yeast. Appl Environ Microbiol. 1995). After the formation of asci (as observed by microscopy), a 100 ul aliquot of cells was resuspended in 100 ul of 1 M sorbitol and treated with 5 U of zymolyase (Zymo Research, Orange Calif.) at 37° C. for 15 min. Resulting tetrads were spread on YPD medium and dissected using a micromanipulator (Singer Instruments, Somerset UK), and the single-spore isolates were grown at 30° C. for 3 d to form colonies. One tetrad with four viable spores was characterized further. The mating type of the single-spore isolates was determined by PCR as described (Huxley, C., E. D. Green and I. Dunham (1990). "Rapid assessment of *S. cerevisiae* mating type by PCR." Trends Genet. 6(8): 236). One spore isolate, of mating type MATa, was designated PNY0865.

PNY2115 was restored back to a histidine prototroph. The HIS3 coding sequence and 500 base pairs (bp) upstream and downstream of the coding sequence were amplified from the haploid PNY0865. PNY2115 was transformed with the resulting PCR product and transformants were selected on agar plates containing synthetic complete media lacking histidine supplemented with 1% ethanol at 30° C. A PNY2115 HIS3+ isolate was designated PNY1566.

PNY1566 was transformed with pLH804 (control ilvD_Sm) (SEQ ID NO:591) and transformants were selected on agar plates containing synthetic complete media lacking uracil supplemented with 1% ethanol at 30° C. Two transformants were selected and designated PNY1604 and PNY1614. PNY1566 was transformed with pLH691 (Δ9 ilvD_Sm) (SEQ ID NO:590) and transformants were selected on agar plates containing synthetic complete media lacking uracil supplemented with 1% ethanol at 30° C. Two transformants were selected and designated PNY1603 and PNY1613.

Example 20

DHAD Activity of C-Terminal Deletion Strains

PNY1603, PNY1613, PNY1604, and PNY1614 were grown overnight in 12 ml of low glucose medium in 125 ml VWR vent cap shake flasks at 30° C. at 250 RPM in a New Brunswick I24 incubated shaker. The low glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.2% weight per volume (w/v) ethanol, 0.3% w/v glucose, 100 mM 2-Morpholinoethanesulphonic acid (MES) buffer, adjusted to pH 5.5 with KOH. Overnight cultures were centrifuged at 3800×g for 5 minutes at room temperature and cell pellets were resuspended in 1 ml of high glucose medium. High glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.1% w/v ethanol, 3.0% w/v glucose, 100 mM 2-Morpholinoethanesulphonic acid (MES) buffer, adjusted to pH 5.5 with KOH. 15 ml of high glucose medium in 125 ml VWR vent cap shake flasks was inoculated with cells to a final OD600 0.4 and grown for 5 hours at 30° C. at 250 RPM in a New Brunswick I24 incubated shaker. Cells were again centrifuged at 3800×g for 5 minutes at room temperature and cell pellets were resuspended in 2 ml of high glucose medium. 30 ml of high glucose medium in 60 ml serum vials (Kimble Chase; Vineland, N.J.) was inoculated with resuspended cells to a final OD600 of 0.15. Serum vials were sealed and cultures were grown at 30° C. at 250 RPM in a New Brunswick I24 incubated shaker for 20 hours. Cultures were centrifuged at 3800×g for 5 minutes at 4° C. The pellets were washed with cold 50 mM HEPES pH 6.8 and then centrifuged at 3800×g for 5 minutes at 4° C. Cell pellets were frozen on dry ice and stored at −80° C. until they were assayed for DHAD activity.

To assay for DHAD activity, frozen yeast cells were thawed, resuspended in 0.1 M K-Hepes pH 6.8 containing 10 mM $MgCl_2$ and a protease inhibitor cocktail (Roche, Catalog #11873580001), and then broken by bead beating. The broken cells were centrifuged to remove the cell debris and generate the yeast crude extract. Protein concentrations (mg/ml) of extracts were measured with the Pierce Coomassie Plus (Bradford) Protein Assay (Catalog #23236, Thermo Scientific). DHAD enzyme activities were measured spectrophotometrically in an end point assay using the 2,4-dinitrophenylhydrazine (2,4-DNPH) method as described in Flint, D. H. and M. H. Emptage, J. Biol. Chem. 263:3558-64, 1988, with modifications. The assay buffer contained 0.1 M K-Hepes pH 6.8 and 10 mM $MgCl_2$. Yeast extracts were diluted in assay buffer. Sufficient (R)-2,3-dihydroxyisovaleric acid was added to assay buffer so that the final concentration in the assay is 10 mM. In each assay, an enzyme containing solution and sufficient substrate containing buffer are mixed so that the final volume is 300 ul. Assay mixtures were incubated at 30° C. for 20 minutes. At five minute intervals, a 60 ul aliquot of each reaction was mixed with 70 ul of a saturated solution of 2,4-DNPH in 1 N HCl. Following a 30 minute incubation at room temperature, 70 ul of 4 N KOH in ethanol was then added to the solution, followed by brief mixing. The absorbance of the mixture was read at 540 nm with a Spectra Max384 Plus plate reader (Molecular Devices, Sunnyvale, Calif.). A standard curve containing 0 mM to 1.33 mM α-ketoisovalerate was employed to calculate enzyme activities (units per ml, or U/ml) for the conversion of (R)-2,3-dihydroxyvalerate to α-ketoisovalerate in the assays. DHAD specific activities (units per mg, or U/mg) were determined from enzyme activities (U/ml) and protein concentrations (mg/ml) measured for each sample.

Figure 16:
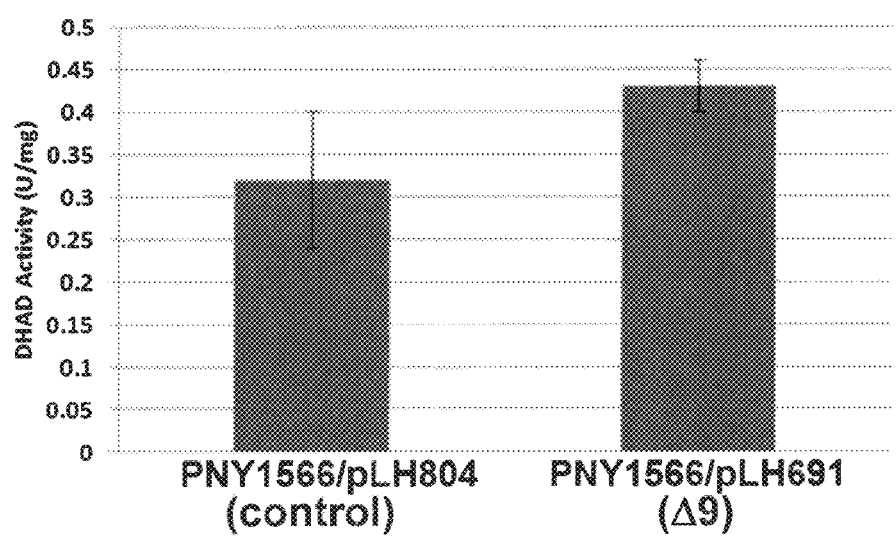
FIG. 16 is a graph illustrating DHAD activity in yeast strains expressing full length *S. mutans* DHAD (PNY1566/pLH804 (control)) and a C-terminal deletion *S. mutans* DHAD (PNY1566/pLH691(Δ9)).

Strains PNY1604 and PNY1614 containing the control ilvD_Sm had an average DHAD activity of 0.32 (U/mg). See FIG. 16. Strains PNY1603 and PNY1613 containing the Δ9 ilvD_Sm had an average DHAD activity of 0.43 (U/mg). See FIG. 16.

Example 21

Isobutanol Production with ilvD_Sm Δ9

Isobutanol production was tested for isobutanologen strains. PNY1604, PNY1614, PNY1603, and PNY1613 were grown overnight in 10 ml of low glucose medium in 125 ml VWR vent cap shake flasks at 30° C. at 250 RPM in a New Brunswick I24 incubated shaker. The low glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.2% w/v ethanol, 0.3% w/v glucose, 100 mM 2-Morpholinoethanesulphonic acid (MES) buffer, adjusted to pH 5.5 with KOH. Overnight cultures were centrifuged at 3800×g for 5 minutes at room temperature and cell pellets were resuspended in 2 ml of high glucose medium. High glucose medium consisted of: 6.7 g/L Difco Yeast Nitrogen Base without amino acids (Becton Dickinson; Sparks, Md.), 1.92 g/L Synthetic Drop-out Medium Supplement without Uracil (Sigma; St. Louis, Mo.), 0.1% w/v ethanol, 3.0% w/v glucose, 100 mM 2-Morpholinoethanesulphonic acid (MES) buffer, adjusted to pH 5.5 with KOH. 10 ml of high glucose medium in 125 ml VWR vent cap shake flasks was inoculated with cells to a final OD600 0.4 and grown for 5 hours at 30° C. at 250 RPM in a New Brunswick I24 incubated shaker. Cells were centrifuged at 3800×g for 5 minutes at room temperature and cell pellets were resuspended in high glucose medium to an OD600 0.2. 10 ml of the culture in high glucose medium was transferred to a 20 ml serum vial (Kimble Chase; Vineland, N.J.). Serum vials were sealed and cultures were grown at 30° C. at 250 RPM in a New Brunswick I24 incubated shaker for 42 hours.

After 42 hours, the cultures were sampled for OD600 and culture supernatants (collected using Spin-X centrifuge tube filter units, Costar Cat. No. 8169) were analyzed by HPLC (as described in Example 4). OD600, isobutanol concentration, and isobutanol molar yield are presented in Table 33.

TABLE 33

Average OD600, isobutanol concentration, and isobutanol molar yield and standard deviations

| Strain | OD600 | Isobutanol (mM) | Isobutanol yield (mol/mol) |
|---|---|---|---|
| PNY1604/PNY1614 (control) | 1.5 ± 0.1 | 81.8 ± 1.9 | 0.60 ± 0.00 |
| PNY1603/PNY1613 (Δ9) | 2.0 ± 0.1 | 81.9 ± 4.9 | 0.60 ± 0.01 |

Example 22

Plasmid Construction for Expression of C-Terminal Deletion Variants of Dehydroxy-Acid Dehydratase (DHAD)

Vector derived from pHR81 (ATCC 87541) was used for expressing wild type (WT) and mutant DHAD from *S. mutans* under the control of FBA promoter. Vector pHR81 FBA-IlvD(Sm) (SEQ ID NO:858) contained WT DHAD. In this vector, the FBA promoter was located in the region from nucleotides (nt) 7626 to 8623. The IlvD gene was located from nt 8631 to 10343, flanked by the restriction enzyme sites for SpeI and NotI. For the expression of the IlvD protein containing a nine amino acid deletion from the C-terminus, vector pHR81 FBA-IlvD(Sm)Δ9 was used (SEQ ID NO:859). In this vector, the IlvD gene with deletion was located in the region from nt 9644 to 11332, flanked by the restriction enzyme sites for SpeI and NotI. The FBA promoter was located from nt 8639 to 9636.

Example 23

DHAD Activity of C-Terminal Deletion Strains

Figure 17:
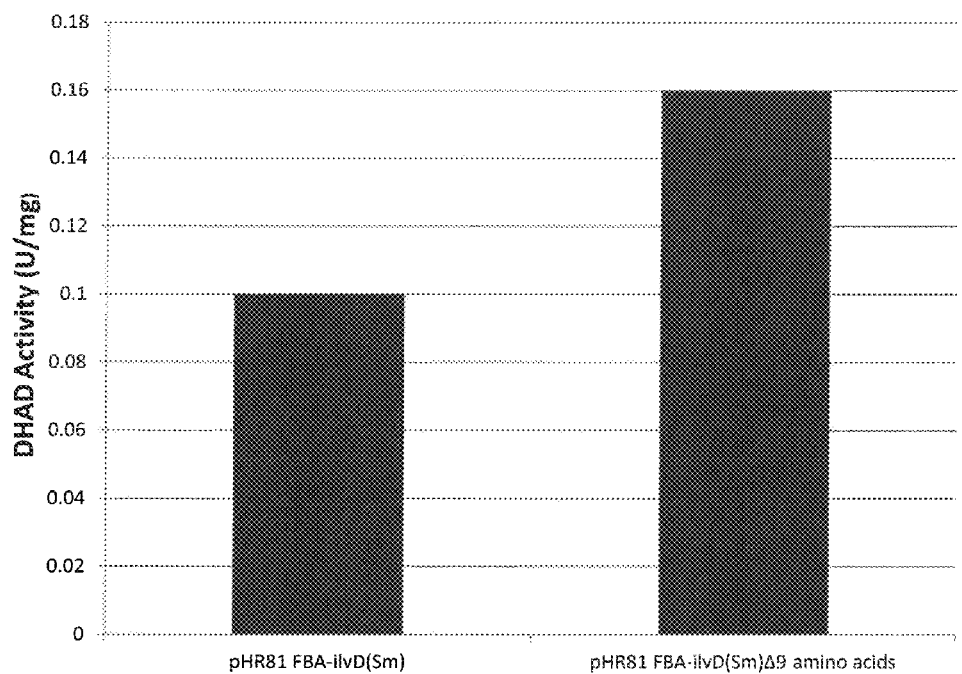
FIG. 17 is a graph illustrating DHAD activity in yeast strains expressing full length *S. mutans* DHAD (pHR81 FBA-ilvD(Sm)) and a C-terminal deletion *S. mutans* DHAD (pHR81 FBA-ilvD(Sm)Δ9 amino acids).

Vectors pHR81 FBA-IlvD(Sm) and pHR81 FBA-IlvD(Sm)Δ9 were transformed into yeast strain BY4741 (ATCC 201388). Competent cells were prepared with a Frozen Yeast Transformation kit (Zymo Research, Irvine, Calif.). The transformants were selected on plates with complete synthetic yeast growth medium minus Ura (Teknova, Hollister, Calif.). Growth on liquid medium was carried out by adding 5 ml of an overnight culture into 100 ml medium in a 250 ml flask. Cells from 80 ml culture were harvested by centrifugation (4,000 rpm for 10 min at 4° C.) and washed with 10 ml TM8 buffer (50 mM Tris, pH 8.0, 10 mM MgSO$_4$) stored at 4° C. The cells were resuspended in 1 ml of TM8 and transferred to lysing matrix tubes with 0.1 mm silica spheres (MP Biomedicals, Solon, Ohio). The cells were broken with a beads beater (4× with 30 seconds each). The crude extract was obtained by centrifugation with a table top microfuge at 12,000 rpm at 4° C. for 30 minutes. The supernatants were removed and stored on ice until assayed for DHAD activity as described above. It was found that the DHADs assayed herein were stable in crude extracts kept on ice for a few hours. DHAD activity was also preserved when samples were frozen in liquid N$_2$ and stored at −80° C. Results from enzymatic measurement (FIG. 17) showed an about 60% increase in DHAD activity with the IlvD enzyme having a nine amino acid deletion at the C-terminus (pHR81 FBA-IlvD(Sm)Δ9) as compared to DHAD activity obtained with the control DHAD enzyme (pHR81 FBA-IlvD(Sm)).

Example 24

Site Directed Mutagenesis of C-terminal Tagged *S. mutans* DHAD

C-terminal-tagged versions of variants in Example 2 were prepared by site directed mutagenesis of C-terminal tagged *S. mutans* DHAD. Site directed mutagenesis of performed as described in Example 2, with modifications.

For the P378A substitution, the mutagenesis reaction contained 1 ul pLH689 (50 ng), 1 ul P2A1 mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the G383S substitution, the mutagenesis reaction contained 1 ul pLH689 (50 ng), 1 ul G2S2mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the L385F substitution, the mutagenesis reaction contained 1 ul pLH689 (50 ng), 1 ul L2F3mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the L385V substitution, the mutagenesis reaction contained 1 ul pLH689 (50 ng), 1 ul L2V4mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the I387V substitution, the mutagenesis reaction contained 1 ul pLH689 (50 ng), 1 ul I2V5mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the 1387M substitution, the mutagenesis reaction contained 1 ul pLH689 (50 ng), 1 ul I2M6 mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the L388I substitution, the mutagenesis reaction contained 1 ul pLH689 (50 ng), 1 ul L217mix (10 uM each primer), 1 ul dNTP mix, 1.5 ul Quiksolution, 5 ul of 10× buffer, 1 ul QuikChange Lightning Enzyme, and 39.5 ul of ddH$_2$O.

For the L388M substitution, the mutagenesis reaction contained 1 ul pLH689 (50 ng), 1 ul L2M8mix (10 uM each primer), 1 ul dNTP mix, 1.5 ul Quiksolution, 5 ul of 10× buffer, 1 ul QuikChange Lightning Enzyme, and 39.5 ul of ddH$_2$O.

The following conditions were used for the reactions: The starting temperature was 95° C. for 2 min followed by 18 heating/cooling cycles. Each cycle consisted of 95° C. for 20 sec, 60° C. for 10 sec, and 68° C. for 10 min. At the completion of the temperature cycling, the samples were incubated at 68° C. for 5.0 min and then held awaiting sample recovery at 4° C. 2 µl of the Dpn I was added to each reaction and the mixtures were incubated for 30 min at 37° C.

TABLE 34

Prepared Variants of C-terminal Tagged S. mutans DHAD

| Variant | Nuc Seq ID | AA Seq ID | Substitution |
|---|---|---|---|
| 689-P2A1 | 860 | 861 | P378A |
| 689-G2S2 | 862 | 863 | G383S |
| 689-L2F3 | 864 | 865 | L385F |
| 689-L2V4 | 866 | 867 | L385V |
| 689-I2V5 | 786 | 787 | I387V |
| 689-I2M6 | 868 | 869 | I387M |
| 689-L2I7 | 870 | 871 | L388I |
| 689-L2M8 | 872 | 873 | L388M |

Example 25

Comparison of DHAD Variant L2V4 (L385V) and L2I7 (L388) with and without C-Terminal Tag Isobutanol-producing strains containing DHAD variant L2V4 (L385V) with and without a C-terminal tag were constructed and evaluated for isobutanol production using the serum vial procedure described in Example 14. These strains were designated PNY2318 (with tag) and PNY2310 (without tag) and are further described below.

PNY2310 was generated by transforming strain PNY2145 (Example 1) with plasmids pLH804-L2V4 (Example 3) and pRS413::BiADH-kivD (Example 1). Plasmid transformants were selected by plating on synthetic complete medium lacking uracil and histidine with 1% (v/v) ethanol as the carbon source. Colonies were transferred to fresh plates by patching. After two days, cells from the patches were transferred to plates containing synthetic complete medium (minus uracil and histidine) with 2% (w/v) glucose as the carbon source. The resulting strain was designated PNY2310. PNY2318 was constructed analogously to PNY2310 except that it was transformed with pLH689-L2V4 (Example 24) instead of pLH804-L2V4. Isobutanol titer (mM) and yield (mole/mole glucose) from 38 hour samples are indicated in Table 35.

TABLE 35

Comparison of isobutanol production by strains containing DHAD variant L2V4 with (PNY2318) and without (PNY2310) a C-terminal tag. For each strain, n = 2.

| Strain | 38 h serum vial titer (mM) +/− standard deviation | 38 h serum vial molar yield +/− standard deviation |
|---|---|---|
| PNY2318 (with C-terminal Tag) | 68.37 +/− 0.07 | 0.695 +/− 0.004 |
| PNY2310 (without C-terminal Tag) | 62 +/− 2 | 0.674 +/− 0.003 |

Isobutanol-producing strains containing DHAD variant L2I7 (L388I) with and without the C-terminal tag were also constructed and evaluated for isobutanol production using the serum vial procedure described in Example 14. Strains were prepared by transforming PNY2145 (Example 1) with plasmid pRS413::BiADH-kivD (Example 1) and either pLH689-L2I7 (Example 24) or pLH804-L2I7 (Example 3). Transformants were obtained as described above and three independent clones of each were tested. Isobutanol titer (mM) and yield (mole/mole glucose) from 40 hour samples are indicated in Table 36.

TABLE 36

Comparison of isobutanol production by strains containing DHAD variant L2I7 with and without a C-terminal tag. For each genotype, n = 3.

| Strain Genotype | 40 h serum vial titer (mM) +/− standard deviation | 40 h serum vial molar yield +/− standard deviation |
|---|---|---|
| PNY2145/pRS413::BiADH-kivD/pLH689-L2I7 (i.e. with C-terminal Tag) | 60 +/− 2 | 0.693 +/− 0.005 |
| PNY2145/pRS413::BiADH-kivD/pLH804-L2I7 (i.e. without C-terminal Tag) | 51 +/− 2 | 0.637 +/− 0.007 |

While various embodiments of the present invention have been described above, it should be understood that they have been presented by way of example only, and not limitation. It will be apparent to persons skilled in the relevant art that various changes in form and detail can be made therein without departing from the spirit and scope of the invention. Thus, the breadth and scope of the present invention should not be limited by any of the above-described exemplary embodiments, but should be defined only in accordance with the following claims and their equivalents.

All publications, patents and patent applications mentioned in this specification are indicative of the level of skill of those skilled in the art to which this invention pertains, and are herein incorporated by reference to the same extent as if each individual publication, patent or patent application was specifically and individually indicated to be incorporated by reference.

SEQUENCE LISTING (875 sequences)

SEQ ID NO: 1 - DNA, 1743 bp, Mycobacterium sp.
atgccctcaggaagttcaggaactcccgctgatgctcttcgcgcgagcgactcatcgccggacatcaagccccgcagccgcgacgtcaccgacggcctcgagaagaccgccgcccgcgggatgctgcgggcggtcggcatgggcgacgacgactgggtcaaaccgcagatcggcgtgggttcgtcgtggaacgagatcaccccgtgcaacatgtcgctgcaacggctggcgcagtcggtgaagggcggcgtgcactccgccggcggatttccgctggagttcggcacgatctcggtgtccgacggcatctcgatgggccacgagggcatgcacttctcgctggtctcgcgtgaggtgatcgccgacagcgtcgagaccgtcgtgcaggccgagcgtctcgacggcacggtgctgctggccggctgcgacaagtcgattcccggcatgctgatggccgccgcccggctcgacctggcctcggtcttcctgtacaacggttcgatcatgccgggcgtcgcgaagctcaccgacggctccgagcgggaagtcacgatcatcgacgccttcgaggcggtcggggcgtgcgcccgcgggctgatgtcccgcgaggacgtcgacatcatcgaacgggcgatctgtccgggtgagggcgcctgcggcggtatgtacaccgccaacaccatggcgtcggcggcggaagcgctcggcatgtcgttgccgggcagcgcatctcctgtggccatcgacaagcggcgcgacgagtacgcgcggaagtcgggtgaggcggtcgtcgagatgctgcgccgcggtatcaccgcccgcgacatcctcaccaaggaggccttcgagaacgcgatcgccgtcgtcatggcgttcggcggctccaccaacgccgtgctgcacctgctggccatcgcgtgggaggccaacgtgaagctcaccctcgaggacttcacccgcgtcgggcagaaggtgccgcacctcgccgacgtcaaaccgttcggccgtcacgtcatgaagcacgtcgacgagatcggcggtgtgcccgtggtgatgaaggcgctgctggacgccggactgctgcacggggactgcctcaccatcaccggcgagaccatggccgagaacctggcccacatcgaaccgccggacccggacggcaaggtgctgcgggcgatgaacaacccgatccacccgaccggcggcatcacgatcctgcacggatcgttggcgcccgagggcgcggtcgtgaagtcggcgggcttcgactccgacgtgttcgagggcaccgcaagggttttcgagcgggagcgggcagccctggacgcactcgaggacggcacgatcacccacggcgacgtcgtcgtcatccgctacgagggacccaagggcgggcccgggatgcgcgagatgctcgccatcaccggtgcgatcaagggtgccggcctgggcaaggacgtgctgctgatgaccgacggccggttctccggcggcaccaccggcctgtgcgtcgggcatatcgcccccgaggcggtcgacggcgggcccatcgcgttcgtgcgcgacggcgaccggatccggctcgacgtcgccaagggcacgctggacctcctggtcgacgaggccgaattcgagtcccgcaaagcgggattcgagccgttgcccccggtgtacaccaccggcgtgctggccaagtacacgaagttggtcgggtcggcggcggtcggcgcggtctgcggctag

SEQ ID NO: 2 - protein, 580 aa, Mycobacterium sp.
MPSGSSGTPADALRASDSSPDIKPRSRDVTDGLEKTAARGMLRAVGMGDDDWVKPQIGVGSSWNEITPCNMSLQRLAQSVKGGVHSAGGFPLEFGTISVSDGISMGHEGMHFSLVSREVIADSVETVVQAERLDGTVLLAGCDKSIPGMLMAAARLDLASVFLYNGSIMPGVAKLTDGSEREVTIIDAFEAVGACARGLMSREDVDIIERAICPGEGACGGMYTANTMASAAEALGMSLPGSASPVAIDKRRDEYARKSGEAVVEMLRRGITARDILTKEAFENAIAVVMAFGGSTNAVLHLLAIAWEANVKLTLEDFTRVGQKVPHLADVKPFGRHVMKHVDEIGGVPVVMKALLDAGLLHGDCLTITGETMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVAKGTLDLLVDEAEFESRKAGFEPLPPVYTTGVLAKYTKLVGSAAVGAVCG

SEQ ID NO: 3 - DNA, 1770 bp, Mycobacterium gilvum
atgtggccgatgaatcgacgggcgcataatcaccccatgccctcagactcacgctcgcattctcttcgcgcaagcggctcatcggtcgacatcaaaccccgcagccgcgacgtgaccgacgggctcgagcgcaccgccgcgcgcggcatgctgcgcgcggtcggcatgaccgacgacgactgggtcaagccccagatcggggtcggctcgtcgtggaacgagatcacgccgtgcaacatgtcgctgcagcggctggcccaggcggtcaagggcggtgtgcacgaggccgggggttacccgctggagttcggcacgatctccgtctccgacggcatctcgatgggccacgagggcatgcacttctcgctggtgtcccgcgaggtcatcgccgacagcgtcgagaccgtggtgcaggccgaacgcctcgacggcacggtgttgctggccggctgcgacaagtcgatccccggcatgctgatggccgcggcccgcctcgatctggcgagcgtgttcttctacaacggctcgatcatgccgggcgtcgcgaagctcaccgacggaagcgagaaggaagtcacgatcatcgacgccttcgaggcggtcggtgcgtgtgcgcgcgggctgatgtcgcgggaggacgtcgacatcatcgagcgggccatctgccccggtgagggcgcctgcggtggcatgtacaccgccaacacgatggcctcggccgccgaggcgctcggcatgtcgctgccgggcagcgcgtctccggtggcgatcgacaagcggcgcgacgactttgcgcgccgctccggcgaggcggtggtcgagatgctgcgtcgcggcatcaccgcccgcgacatcctgaccaaggaggccttcgagaacgcgatcgccgtcgtgatggccttcggcggttccaccaacgcggtgctgcatctgctggccatcgcgtgggaggcgcaggtcgagctgacgctggcggacttcacccggatcgggcagaaggtgccgcacctggcggatgtgaagccgttcggcgcgtacgtgatgaagcacgtcgacgagatcggcggcgtgccggtggtgatgcgggcactgctcgacgccggactgctgcacggggactgcctcacggtgaccggtcagacgatggccgagaacctggcccacatcgagccgccggaccccgacggcaaggtgctgcgggcgatgaacaacccgatccacccgaccggcggcatcacgatcctgcacggatcgctggcccccgagggcgcggtggtcaagtcggccggcttcgactccgacgtgttcgagggcaccgcacgggttttcgagcgcgaacgggcggcgctcgacgcgctggaggacggcacgatcacccacggcgacgtcgtcgtcatccgttacgagggccccaagggcggcccggggatgcgcgagatgctggcgatcaccggtgcgatcaagggcgccgggctgggcaaggacgtgctgctgatgaccgacggacggttctcgggcgggacgacgggtctgtgcgtcgggcacatcgcgccggaggccgtcgacggcggaccgatcgcattcgtgcgtgacggggacaggatccggttggacgtcgccaacggcacgctggacatcctcgtcgacgaggccgagttcgaatcgcgcaaggcgggcttcgaaccgctgccgccggtctacacgacgggggtgctcgccaagtacacgaagctggtgggttcggcggcggtcggcgcggtctgcagttag

SEQ ID NO: 4 - protein, 589 aa, Mycobacterium gilvum
MWPMNRRAHNHPMPSDSRSHSLRASGSSVDIKPRSRDVTDGLERTAARGMLRAVGMTDDDWVKPQIGVGSSWNEITPCNMSLQRLAQAVKGGVHEAGGYPLEFGTISVSDGISMGHEGMHFSLVSREVIADSVETVVQAERLDGTVLLAGCDKSIPGMLMAAARLDLASVFFYNGSIMPGVAKLTDGSEKEVTIIDAFEAVGACARGLMSREDVDIIERAICPGEGACGGMYTANTMASAAEALGMSLPGSASPVAIDKRRDDFARRSGEAVVEMLRRGITARDILTKEAFENAIAVVMAFGGSTNAVLHLLAIAWEAQVELTLADFTRIGQKVPHLADVKPFGAYVMKHVDEIGGVPVVMRALLDAGLLHGDCLTVTGQTMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGTLDILVDEAEFESRKAGFEPLPPVYTTGVLAKYTKLVGSAAVGAVCS

SEQ ID NO: 5 - DNA, 1716 bp, Mycobacterium smegmatis
atgccctcagacgacaagtccactgagactcctgacatcaagccccgcagtcgcgacgtcaccgacggcctcgagaaggcggccgcccgtgggatgctccgtgcggtaggcatgggcgacgccgactgggccaagccgcagatcggcgtcgggtcgtcgtggaacgagatcacgccgtgcaacatgtcgctgcagcgcctcgcgaagtcggtcaaggacggcgtccacgaggcgggcggctacccgctcgaattcggcaccatctcggtgtccgacggcatctcgatgggccacgagggcatgcacttctcgctggtctcgcgcgaggtgatcgccgacagcgtcgagaccgtcgtgcaggccgagcgcctcgacggcacggtcctgctggccggctgcgacaagtccattccgggcatgctcatggctgccgcgcggctggacctcgcctcggtgttcttctacaacggctcgatcatgccgggtgtcgcgaagctgaccgacggcaccgagaaggaagtcacgatcatcgacgcgttcgaggccgtcggcgcgtgcgtgcgcggcctgatgtcgcgtgaggacgtcgacatcatcgagcgcgcgatctgccccggcgagggtgcctgcggcggcatgtacaccgccaacaccatggccagcgccgccgaggccctcggcctgtcgctgcccggcagcgcgtcgccggtcgccatcgacaagcgccgcgacgagttcgcgcgccgctccggcgaggccgtcgtcgacatgctgcgtcgcggcatcaccgctcgcgacatcctcaccaaggaggccttcgagaacgccatcgccgtggtcatggcgttcggcgggtccaccaacgccgtgctgcacctgctggcgatcgcccgcgaggccgaggtggagctgacgctcgacgatttcacgcgcgtcggcagcaaggtcccgcacctcgcggacgtcaagccgttcggccgccatgtcatgaagcacgtcgacgagatcggcggtgtgcccgtggtgatgcgcgctctgctggatgccggtctgctgaacggcgagtgcctgacggtcacgggcaagaccatggccgagaacctggcccacatcgctcccccggatcccgacggcaaggtgctgcgggccatgaacaacccgatccacccgaccggcggcatcacgatcctgcacggctcgctcgctcccgagggtgcggtggtcaagtcagccggcttcgattcggacgtgttcgagggcactgcaagggttttcgaccgcgaacgtgccgcgatggacgcgctcgaggacggcaccatccaggcgggcgacgtcgtggtgatccgctacgagggccccaagggcggtcccggtatgcgcgagatgctcgcgatcaccggcgccatcaagggtgcgggtctgggcaaggacgtgctgctgatgaccgacggtcggttctcgggcggtacgacgggtctgtgcgtcgggcacatcgcgccggaggccgtcgacggcggcccgatcgcgttcgtgcgcgacggtgaccgcatccgcctcgacgtcgccaagggcacgctcgacgtgctcgtcgacgaagaagagttcgaggcccgcaaggccggcttcgaacccctgccgccgcggtacaagaccggtgtgctggccaagtacaccaagctggtccagtccgccgccgtcggcgcagtctgcacctaa

SEQ ID NO: 6 - protein, 571 aa, Mycobacterium smegmatis
MPSDDKSTETPDIKPRSRDVTDGLEKAAARGMLRAVGMGDADWAKPQIGVGSSWNEITPCNMSLQRLAKSVKDGVHEAGGYPLEFGTISVSDGISMGHEGMHFSLVSREVIADSVETVVQAERLDGTVLLAGCDKSIPGMLMAAARLDLASVFFYNGSIMPGVAKLTDGTEKEVTIIDAFEAVGACVRGLMSREDVDIIERAICPGEGACGGMYTANTMASAAEALGLSLPGSASPVAIDKRRDEFARRSGEAVVDMLRRGITARDILTKEAFENAIAVVMAFGGSTNAVLHLLAIAREAEVELTLDDFTRVGSKVPHLADVKPFGRHVMKHVDEIGGVPVVMRALLDAGLLNGECLTVTGKTMAENLAHIAPPDPDGKVLRAMNNPIHPTGGITILHGSLAPEGAVVKSAGFDSDVFEGTARVFDRERAAMDALEDGTIQAGDVVVIRYEGPKGGPGMREMLAITGAIKGAGLGKDVLLMTDGRFSGGTTGLCVGHIAPEAVDGGPIAFVRDGDRIRLDVAKGTLDVLVDEEEFEARKAGFEPLPPRYKTGVLAKYTKLVQSAAVGAVCT

SEQ ID NO: 7 - DNA, 1698 bp, Mycobacterium vanbaalenii
atgccctcatcgccagacatcaagccccgtagccgcgacgtcaccgacggcctggagaaggccgccgcccggggaatgctgcgcgcggtaggcatgggcgacgaggacttcgccaaaccgcagatcggcgtcggctcgtcctggaacgagatcaccccgtgcaacctgtcgctggaccggctcgccaaggcggtcaaggaaggcgtcttcgaggccggcggcttcccgatggagttcggcaccatctcggtttccgacggcatctcgatgggccatgaaggcatgcacttttcgttggtgtcgcgcgagatcatcgccgacagcgtcgagacggtgatgcaggccgagcgtctggacggctcggtgctgctcgccggatgcgacaagtcgctgcccggcatgctgatggccgctgcgcggctcgacctggccagcgtttttctctacgccggctcgatcctgcccggccgggtcaagctgtccgacggcagcgagaaggacgtcacgatcatcgacgccttcgaggccgtcggcgcctgcgcgcgcgggctgatgccccgcgaggacgtcgacgccatcgagcgtgcgatctgcccgggtgaaggcgcctgcggcggcatgtacaccgccaacacgatggccagcgccgccgaggcgctcggcatgtcgctgcccggctccgccgccccgccggccaccgaccggcgccgcgacggcttcgcccgcaagagcggcatggccgtcgtcgaactgctgcgccgaggcatcaccgcccgcgacatcctgaccaaggaggcgttcgagaacgcgatcgcggtcgtgatggcgttcggcggctccaccaacgcggtgctgcacctgctcgcgatcgcctacgaggccaacgtcaagctgaccctggaggacttcacccgcgtcggcgccaaggtgccgcacctggccgacgtgaaaccgttcggcgcgtacgtgatgaacgacgtcgaccggatcggcggcgttccggtcgtgatgaaggctctgctggacgccggtctgctgcacggggactgcctcaccgtcaccggtaagacgatggccgagaaccttgcccacatcgccccgcccgaccccgacggcaaggtgctgcgcgctctcagcaggccgatccatcccaccggcggcatcacgatcctgcacggctcgctggctcccgaaggtgcggtggtgaagtccgccgggttcgactccgacgtgttcgaaggcaccgcaagggttttcgagcgtgaacgggcagcgctcgacgcgctggaggacggcaccatcacgcacggcgacgtcgtggtcatccgttacgagggccccaagggcggtccgggcatgcgcgaaatgctcgccatcacaggcgcaatcaagggcgccgggctcggcaaggatgtgctgttgatgaccgacggccggttctccggcggcaccaccggtctgtgcgtcggccacatcgccccggaagcggtcgacggcggacccatcgccttcatcaaggacggcgacaagatccgtctcgacgtggccaagggcaccctcgacgttgtggtcgacaaggacgaattcgaggcgcgcaaagtcgggttcgagccgcttccccccgtctacaccaccggggtgctggccaagtacaccaagctcgtcggctcggcggccaccggcgcggtctgcacgtag

SEQ ID NO: 8 - protein, 565 aa, Mycobacterium vanbaalenii
MPSSPDIKPRSRDVTDGLEKAAARGMLRAVGMGDEDFAKPQIGVGSSWNEITPCNLSLDRLAKAVKEGVFEAGGFPMEFGTISVSDGISMGHEGMHFSLVSREIIADSVETVMQAERLDGSVLLAGCDKSLPGMLMAAARLDLASVFLYAGSILPGRVKLSDGSEKDVTIIDAFEAVGACARGLMPREDVDAIERAICPGEGACGGMYTANTMASAAEALGMSLPGSAAPPATDRRRDGFARKSGMAVVELLRRGITARDILTKEAFENAIAVVMAFGGSTNAVLHLLAIAYEANVKLTLEDFTRVGAKVPHLADVKPFGAYVMNDVDRIGGVPVVMKALLDAGLLHGDCLTVTGKTMAENLAHIAPPDPDGKVLRALSRPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFIKDGDKIRLDVAKGTLDVVVDKDEFEARKVGFEPLPPVYTTGVLAKYTKLVGSAATGAVCT

SEQ ID NO: 9 - DNA, 1707 bp, Nocardia farcinica
gtggccgagcagacgaacacccccgacctcaagccccgcagccgcgacgtcaccgacgggctggaacgcaccgccgcccgcggcatgctgcgcgcggtgggcatgggcgacgacgactgggagaagccgcagatcggcgtcgcctcctcctggaacgagatcaccccgtgcaacctgtcgctggaccggctcgcgcagggctgcaaggacggcgtgttcgccgccggtggcttcccgatgcagttcggcaccatctcggtctccgacggcatctcgatgggccacgagggcatgcacttctcgctggtgtcgcgcgaagtgatcgccgacagcgtggagacggtgatgcaggccgagcggctcgacggctcggtgctgctggccgggtgcgacaagtcgctgcccggcatgctgatggccgcggcccgcctcgacctggccagcgtgttcctctacgcgggctcgatcctgcccggcatcgccaagctctccgacggcaccgagcgcgaggtgacgatcatcgacgcgttcgaggcggtcggagcgtgcgcgcgcgggctgatgagccgggccgacgtcgacgccatcgaacgcgcgatctgtcccggcgagggcgcctgcggcggcatgtacaccgccaacacgatggccagcgcggccgaggcgctgggcatgtcgctgcccggcagcgccgcaccgcccgccaccgaccgccgccgcgacgggtacgcccgccgcagcggtcaggccgtggtcgagctgctgcgccgcggcatcaccgcccgcgacatcctcaccaaggaggcgttcgagaacgccatcgcggtggtgatggccttcggcggctcgaccaacgcggtgctgcacttgctcgcgatcgcgcacgaggcgcgggtggagctcaccctcgacgatttcgcgcgggtgggcaggcgggtgccgcacctggccgacgtcaagccgttcggcgcgcatgtgatgaccgatgtcgaccgcatcggcggcgtgccggtgatgatgaagaccctgctcgacgccgggctgctgcacggtgactgcctcaccgtcaccggccgcaccgtcgcggagaacctcgcccacatcgccccgcccgacccggacggcaaggtggtgcgcgcgctgaacgatccgatccatcccaccggcggcatcaccatcctgtccggctcgctggcgcccggcggggcggtggtgaaatccgccggtttcgacgaggacgtcttcaccggcacggccagggtcttcgatcgcgaacgcgccgcgatggacgcgctcgaggacggcaccatcaccgcaggcgacgtggtggtcatccgctacgagggccccaagggcggacccggcatgcgcgagatgctggccatcaccgccgccatcaagggcgcgggcctgggcaaggacgtgctgctgctcaccgacggccgcttctccggtggcaccaccggactgtgtgtcgggcacgtcgcgcccgaggcggtggacggtggtccgatcgcgttcgtccgcgacggcgaccgcatccggctcgacgtggccgcgggcaccctggacctgctggtggagcccgccgaactcgagcggcgcaaacaggactggcgaccgctgccgccgcgctacacccgcggcgtgctcgccaagtacaccaagctggtcggttcggcctcggtcggcgcggtctgcgactga

SEQ ID NO: 10 - protein, 568 aa, Nocardia farcinica
MAEQTNTPDLKPRSRDVTDGLERTAARGMLRAVGMGDDDWEKPQIGVASSWNEITPCNLSLDRLAQGCKDGVFAAGGFPMQFGTISVSDGISMGHEGMHFSLVSREVIADSVETVMQAERLDGSVLLAGCDKSLPGMLMAAARLDLASVFLYAGSILPGIAKLSDGTEREVTIIDAFEAVGACARGLMSRADVDAIERAICPGEGACGGMYTANTMASAAEALGMSLPGSAAPPATDRRRDGYARRSGQAVVELLRRGITARDILTKEAFENAIAVVMAFGGSTNAVLHLLAIAHEARVELTLDDFARVGRRVPHLADVKPFGAHVMTDVDRIGGVPVMMKTLLDAGLLHGDCLTVTGRTVAENLAHIAPPDPDGKVVRALNDPIHPTGGITILSGSLAPGGAVVKSAGFDEDVFTGTARVFDRERAAMDALEDGTITAGDVVVIRYEGPKGGPGMREMLAITAAIKGAGLGKDVLLLTDGRFSGGTTGLCVGHVAPEAVDGGPIAFVRDGDRIRLDVAAGTLDLLVEPAELERRKQDWRPLPPRYTRGVLAKYTKLVGSASVGAVCD

SEQ ID NO: 11 - DNA, 1695 bp, Rhodococcus sp.
atgagtaccccggatcccaaaccccgcagccgtgacgtcaccgacggattggagaagaccgcagcgcgcggaatgctccgtgcggtgggcatgggcgacgacgactgggggaaatcccagatcggcgtggcgtcgtcctggaacgagatcaccccctgcaacctgtcgctcgaccggctcgcgaaggccgtcaaggacggcgtccacgccgcaggcgggtatcccctcgagttcggcaccatctccgtgtccgacggcatctcgatgggacacgagggcatgcacttctccctcgtctcccgtgaggtgatcgccgacagcgtggaaacggtgatgcaggccgaacgcctcgacgggtcggtgctcctcgccggttgcgacaagtccctgcccggcatgctgatggccgcggcccgcctcgacctcgcgagcgtgttcctctacgccggttcgatcctgcccggtgtcgcaaaaatgtccgacggcaccgaacgcgacgtcaccatcatcgacgcgttcgaggcggtcggcgcctgttcgcgcggactgatgagccgtgaggacgtcgacgccatcgagcgtgccatctgtcccggcgagggcgcgtgcggcggaatgtacaccgcgaacacgatggccagtgccgccgaggcgctcggcatgtcgctgcccggcagcgcctccccgcccgccaccgaccgtcgtcgcgacggattcgcgaggcgcagcggtgaagccgtcgtcgaactgctccgccgcggcatcaccgccagggacatcctcaccaaggaagcgttcgagaacgccatcgccgtggtcatggccttcggcggttccaccaacgccgtcctgcacctgctggcgatcgcgagcgaagcggatgtggaactgaccctcgacgacttctcccgcgtcggcgcccgcgtcccgcacctcgcggacgtcaaaccgttcggcaagcacgtgatgaaggacgtcgaccacatcggcggcgtccccgtcatcatgaaggccctgctcgacgccgggatgctgcacggcgactgcctcaccgtcaccggcaagaccatggccgagaacctgtcggccatcgcccctcccgacccggacggcaaggtgctccgcgcgatgagttcgcccatccacccgaccggcggaatcacgatcctcaaggggtccctcgccccgggcggcgcggtggtgaagtcggccgggttcgactccgacgtcttcaccggcaccgcccgcgtcttcgaacgggaacgcgccgcgatggatgccctcgaggacggcaccatcacgaacggcgacgtcgtggtcatccgctacgagggccccaagggcggtcccggcatgcgcgagatgctcgcgatcaccggcgcgatcaagggcgccgggctgggcaaggacgtcctcctgctcaccgacggccgattctccggcggcaccaccggcctgtgcgtcggccacgtggcaccggaagccgtcgacggcggtcccatcgcgttcgtccgcgacggcgaccagatccgactggacgtcggaacgggcaccctcgaactgctcgtcgacgaagaggaactcgccggccgcaagaacgggtgggagcctctgcccccgcgctacacccgcggggtcctggccaagtacacgaagctcgtcggttccgcctcgggcggcgccgtctgcgggtag

SEQ ID NO: 12 - protein, 564 aa, Rhodococcus sp.
MSTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLASVFLYAGSILPGVAKMSDGTERDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEADVELTLDDFSRVGARVPHLADVKPFGKHVMKDVDHIGGVPVIMKALLDAGMLHGDCLTVTGKTMAENLSAIAPPDPDGKVLRAMSSPIHPTGGITILKGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEEELAGRKNGWEPLPPRYTRGVLAKYTKLVGSASGGAVCG

SEQ ID NO: 13 - DNA, 1695 bp, Mycobacterium ulcerans
atgccagaagccgatatcaagccccgtagccgcgacgtcactgacggactggaaaaagccgctgcccgtggcatgttgcgggcggtaggcatggtcgacgaagacttcgccaaggcacagatcggggttgcctcgtcctggaacgagattacgccgtgcaacctctcgctggaccggctggccaagtcggtgaaagagggggtgttcgccgcgggcggctacccgcttgagttcggcacgatttcggtctccgacggcatttcgatgggtcacgagggcatgcacttctccctggtgtcgcgcgaagtgatcgccgacagcgtggaaaccgtgatgcaggccgagcgcctcgacggctcggtgctgctggccggatgcgacaaatccctgcccggaatgctgatggccgccgcccgtttggatttggcgtcggtgtttctctacgcgggctcgatccttccgggggtcgccaagctctccgacggcagcgaacgcgaggtcaccatcatcgacgcgttcgaagcggtcggcgcgtgctcgcgagggttgatgagccgagccgacgtcgacgccatcgagcgcgcgatctgccccggcgagggtgcctgtggcgggatgtacacggccaacacgatggccagtgccgctgaagcacttggcatgtcgctgccgggcagcgcggcgcccccggccaccgaccgccgccgcgacgggttcgcccggcaaagcggtcaagccgtcatcgaattgctgcgccagggcattaccgctcgcgacatcatgacccgggaggcgttcgagaacgccatcgcggtggtgatggcattcggcggctcgaccaatgcggtgctgcacctgctggcgatcgcccatgaggccaacgtcgagctcacgctcgacgacttcagccggatcggctcgaaggtgccgcacctagccgatgtcaagccgttcggccgccatgtgatgtcccacgtcgaccacatcggcggtgtgccggtggtcatgaagactttgctggatgccggcctgctgcacggggattgcctgaccgtgaccggccggaccgtggccgagaacctggaggccattgctccgccggacccggacggcaaggtgctacgcgcgctgatcaacccgatccatgcgaccgggggcatcaccatcctgcgtggatccctggcccccgaaggtgccgtggtcaagacggccggcttggacaccgatgtattcgaaggaacggcacgggttttcgacggcgagcgggccgcgctggatgccctcgaggacggcaccatcacccacggtgacgtggtggtgatccgttacgagggacccaagggcggccccgggatgcgggagatgctcgccatcaccggcgcgatcaagggcgccgggctcggcaaagacgtgctgctgttgaccgacggtcgattctccggcggcacaacgggcttctgtgtgggacacatcgcacccgaggcggtggatgccggaccgatcgcgttcgtgcgcgacggcgaccggatccggctcgacgttgccggccggacgctcgacgttctgaccgacccgccagagttcgcggcccgtcaacagaatttcactcctccggcgccgcgttacaagaccggcgtactggccaagtacgtcaagctggtcggctccgccgcgatcggcgcggtctgcggctaa

SEQ ID NO: 14 - protein, 564 aa, Mycobacterium ulcerans
MPEADIKPRSRDVTDGLEKAAARGMLRAVGMVDEDFAKAQIGVASSWNEITPCNLSLDRLAKSVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACSRGLMSRADVDAIERAICPGEGACGGMYTANTMASAAEALGMSLPGSAAPPATDRRRDGFARQSGQAVIELLRQGITARDIMTREAFENAIAVVMAFGGSTNAVLHLLAIAHEANVELTLDDFSRIGSKVPHLADVKPFGRHVMSHVDHIGGVPVVMKTLLDAGLLHGDCLTVTGRTVAENLEAIAPPDPDGKVLRALINPIHATGGITILRGSLAPEGAVVKTAGLDTDVFEGTARVFDGERAALDALEDGTITHGDVVVIRYEGPKGGPGMREMLAITGAIKGAGLGKDVLLLTDGRFSGGTTGFCVGHIAPEAVDAGPIAFVRDGDRIRLDVAGRTLDVLTDPPEFAARQQNFTPPAPRYKTGVLAKYVKLVGSAAIGAVCG

SEQ ID NO: 15 - DNA, 1728 bp, Mycobacterium avium
atgcccaccaccgattcggcgcgcgccgccgacatcaagcagcccgacatcaagccgcgcagtcgtgacgtcaccgacggcctggagaaggccgccgcccgggggatgctgcgggcggtaggcatgggcgacgaggacttcgccaagccgcagatcggggtggcgtcgtcctggaacgagatcacgccgtgcaacctgtcgctggaccggctggccaaggcggtcaaggaaggcgtcttcgccgcgggcggctacccgctggagttcggcaccatctcggtgtccgacggcatctcgatgggccacgagggcatgcacttctcgctggtgagccgcgaggtgatcgccgacagcgtcgagacggtgatgcaggccgagcgcctggacggctcggtgctgctggccggctgcgacaagtcgctgcccggcatgctgatggccgcggcccgcctggacctggcctcggtgttcctctacgccggctcgatcctgcccggggtggccaagctgtccgacggcagcgagcgcgaggtgacgatcatcgacgcgttcgaggccgtcggcgcgtgcgcgcgcgggctgatgccgcgcgaggacgtcgacgccatcgagcgggccatctgtcccggcgagggcgcctgcggcggcatgtacacggccaacaccatggccagcgccgccgaggcgctggggatgtcgctgccgggcagcgcggccccgccggccaccgaccgccgccgcgacggcttcgcccggcgcagcggccaggccgtcgtcgagctgctgcgccgcggcatcaccgcccgcgacatcctcaccaaggaggcgttcgagaacgcgatcgcggtggtgatggcgttcggcggctccaccaacgcggtgctgcacctgctggccatcgcccacgaggccgacgtggcgctgtcgctcgacgacttcagccggatcgggtcgaaggtgccgcacctggccgacgtcaagccgttcggccggcacgtgatgaccgacgtcgaccacatcggcggcgtgccggtgatgatgaaggcgctgctggacgccgggctgctgaacggcgactgcctgacggtgaccggtgcgacggtggcgcagaacctggccgcgatcgccccgcccgacccggacggcaaggtgctgcgggcactcagcgatccgttgcacccgaccggcggcatcaccatcctgcgcgggtcgctggcgcccgagggcgcggtggtcaagtccgccggcttcgattccgacgtgttcgaaggcaccgcaagggttttcgacggcgagcgggccgcgctggacgcgctggaggacggcaccatcaccaagggcgacgcggtggtgatccggtacgagggccccaagggcgggcccgggatgcgcgagatgctcgccatcaccggcgcgatcaagggcgccgggctgggtaaggacgtgctgttactcaccgacggccgcttctccggcgggacgacgggactgtgtgtcggccacatcgcgcccgaggcggtggacgcagggccgatcgcctttctgcgcgacggcgaccgcatccgcctggacgtcgccaaccgggttctggacgtactcgtcgatccggccgaattcgactctcggcgaacaggtttcaccccgccgccgccccgctacaagaccggggtgctggccaagtacgtcaagctcgtcggttccgcggcgatcggcgccgtctgcggctag

SEQ ID NO: 16 - protein, 575 aa, Mycobacterium avium
MPTTDSARAADIKQPDIKPRSRDVTDGLEKAAARGMLRAVGMGDEDFAKPQIGVASSWNEITPCNLSLDRLAKAVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACARGLMPREDVDAIERAICPGEGACGGMYTANTMASAAEALGMSLPGSAAPPATDRRRDGFARRSGQAVVELLRRGITARDILTKEAFENAIAVVMAFGGSTNAVLHLLAIAHEADVALSLDDFSRIGSKVPHLADVKPFGRHVMTDVDHIGGVPVMMKALLDAGLLNGDCLTVTGATVAQNLAAIAPPDPDGKVLRALSDPLHPTGGITILRGSLAPEGAVVKSAGFDSDVFEGTARVFDGERAALDALEDGTITKGDAVVIRYEGPKGGPGMREMLAITGAIKGAGLGKDVLLLTDGRFSGGTTGLCVGHIAPEAVDAGPIAFLRDGDRIRLDVANRVLDVLVDPAEFDSRRTGFTPPPPRYKTGVLAKYVKLVGSAAIGAVCG

SEQ ID NO: 17 - DNA, 1728 bp, Mycobacterium tuberculosis
atgccgcaaaccaccgacgaagccgcttccgtctcgacggtcgccgacatcaagccccgcagtcgagacgtcaccgacggcctggagaaggccgctgcccggggcatgttgagggcggtgggcatggacgacgaagacttcgcgaagccacagatcggggtcgcgtcgtcgtggaacgaaatcacgccgtgcaatctctcattggaccggctggccaacgcggtcaaggagggggtgttttcggccggcggctatccgcttgagttcggcacgatctcggtttcggacggcatctccatgggtcatgaggggatgcacttctcgctggtttcccgtgaggtgatcgccgacagcgtcgaagtcgtgatgcaggccgaacgactcgacggttcggtgctgctggccggatgcgacaaatcgctgcccggaatgctgatggccgccgcacgactggatctggcggcggtgttcctctacgcgggctctattttgcccggccgggccaagctctccgacggtagcgaacgagacgtcaccatcattgacgccttcgaggcggtcggagcgtgctctcgcggtttgatgagtcgcgccgacgtcgatgccatcgagcgggcaatctgccccggcgaaggggcatgcggcggcatgtacaccgctaacaccatggccagcgccgccgaggcgctcggcatgtcgttgccgggcagcgcggcaccgccggcgaccgaccgccggcgcgacgggttcgcgcgtcgcagcgggcaggccgtcgtcgagctgctgcgccgcggcatcaccgcccgcgacatcctcaccaaggaggcgttcgagaacgccatcgcggtgggaatggcgttcggcggctcgaccaacgcggtgctgcatctgctggccatcgcccacgaggccaacgtcgcactatcgcttcaggacttcagccggatcgggtcgggggtgccgcatttggccgatgtcaagccgttcggccgccatgtgatgtccgacgtcgatcacatcggcggtgtgccggtggttatgaaggcgctgctggacgccggtctgctacacggcgactgcctgacggttaccggtcacaccatggccgagaatctggctgccatcaccccgccggatccagatggcaaggtgctacgtgcgttggcaaacccgatccacccgagcggtggcatcaccatcctgcacggatcgctggcacccgaaggtgcggtggtcaagaccgccggattcgattccgacgtattcgaaggcaccgcaagagttttcgacggcgagcgcgctgcgctggacgcccttgaggatggcaccattaccgtgggcgacgccgtggtaatccggtacgaaggacccaagggcggccccgggatgcgcgaaatgctcgccatcacaggcgcgatcaaaggcgcaggactcggtaaagatgttctactgctgaccgacggccggttctccggtggaaccaccggcctgtgcgttggccacatcgcaccggaggcggtcgacggcggaccgatcgcacttctgcgcaacggcgaccggatccggctcgacgtggccggccgcgttctcgatgtgttggccgatccggccgaattcgcgtcccgacaacaggatttcagtcctccaccgccgcgctacactactggcgtactgtccaagtacgtcaagctggtcagctctgccgcggtcggcgcggtctgcggctag

SEQ ID NO: 18 - protein, 575 aa, Mycobacterium tuberculosis
MPQTTDEAASVSTVADIKPRSRDVTDGLEKAAARGMLRAVGMDDEDFAKPQIGVASSWNEITPCNLSLDRLANAVKEGVFSAGGYPLEFGTISVSDGISMGHEGMHFSLVSREVIADSVEVVMQAERLDGSVLLAGCDKSLPGMLMAAARLDLAAVFLYAGSILPGRAKLSDGSERDVTIIDAFEAVGACSRGLMSRADVDAIERAICPGEGACGGMYTANTMASAAEALGMSLPGSAAPPATDRRRDGFARRSGQAVVELLRRGITARDILTKEAFENAIAVGMAFGGSTNAVLHLLAIAHEANVALSLQDFSRIGSGVPHLADVKPFGRHVMSDVDHIGGVPVVMKALLDAGLLHGDCLTVTGHTMAENLAAITPPDPDGKVLRALANPIHPSGGITILHGSLAPEGAVVKTAGFDSDVFEGTARVFDGERAALDALEDGTITVGDAVVIRYEGPKGGPGMREMLAITGAIKGAGLGKDVLLLTDGRFSGGTTGLCVGHIAPEAVDGGPIALLRNGDRIRLDVAGRVLDVLADPAEFASRQQDFSPPPPRYTTGVLSKYVKLVSSAAVGAVCG

SEQ ID NO: 19 - DNA, 1695 bp, Mycobacterium lepraea
atgatgccccctgacatcaaaccccgcagccgcgacgttaccgatggcctggagaaggccgctgctcgtggcatgttgcgcgcagtcggcatgaacgatgacgacttcgccaaggcgcagatcggagttgcgtcatcatggaacgagatcacaccttgcaatctctcgctggaccgcctggccaaggcggtcaaggagggggtattctcggccggcggttatccgcttgagttcggaacaatttcggtttccgacggcatctcgatggggcaccaggggatgcacttctcgctggtgtcgcgcgaggttatagcggacagcgtcgaaaccgtaatgcaggccgagcgcctcgacggctcagtgcttttggctggctgcgataaatcactacccggaatgctgatggccgccgcacgtctcgacctcgcgtcggtatttctctacgccggctcgatcttgcccggacgaaccaagctctccgacggcaccgaacacgaagtcacgctcatcgacgcattcgaagcggtcggcgcgtgttctcgcggattaatgccccgcgctgatgtcgacgccatcgagcgggcgatctgccccggcgagggggcatgcggtggcatgtacactgccaacactatggccagcgcagcagaggcgctgggtatgtccttgccgggcagcgctgcgccgccggcaacagaccgtcgccgtgatggcttcgcgcggcgtagcgggcaggccgtcatcgaactgctgcgtcgcggtataaccgctcgcgacatccttaccaaggaagcgtttgagaacgcgatcgcggtggtgatggcgttcggtggctcgaccaacgcgatcctgcatctactggccattgcccatgaggccgacgtcaccttgtcgctcgaggacttcagtcggatcggatttaaggtgccgcatatagccgacgttaagccgttcggccggcacgtgatgttcgacgtcgaccacatcggtggtgtgccggtggtaatgaaagcacttctggacgcaggtctactgcacggtgattgcctgacggtgaccggtcagacgatggccgagaacctagcctccattgccccgccagacccggatggccaggtgatccgcacgttgcataatccaattcatccgacgggaggcattacgatcctgcgtggatcgttggcacctgatggcgcggtggttaagacggctggactcgactccgatgtgttcgaaggaactgcaagggttttcgacggagaacgggccgcgttggacgcactcaaggacggcaccatcgccaaaggcgatgttgtggttatccgctatgaaggcccgaaaggcggcccggggatgcgcgaaatgctagccatcaccggtgccatcaaaggtgccgggctaggcaaagatgttctgctacttactgacggcaggttctctggcggaacgaccggcttttgcgtaggacacatcgcgccggaagctgtcgaagcgggaccaatcgcattcctgcgtgacggcgaccgggtcctgctagacgttgtcggctgctccctcgatgtgctggtcgatccagtcgaattttcctctcggaaaaaggatttcattcctcctgcgccacgctacaccaccggtgtgcttgccaagtacgtcaagctcgtcagttcggcgacggtcggcgcggtctgcggttag

SEQ ID NO: 20 - protein, 564 aa, Mycobacterium lepraea
MMPPDIKPRSRDVTDGLEKAAARGMLRAVGMNDDDFAKAQIGVASSWNEITPCNLSLDRLAKAVKEGVFSAGGYPLEFGTISVSDGISMGHQGMHFSLVSREVIADSVETVMQAERLDGSVLLAGCDKSLPGMLMAAARLDLASVFLYAGSILPGRTKLSDGTEHEVTLIDAFEAVGACSRGLMPRADVDAIERAICPGEGACGGMYTANTMASAAEALGMSLPGSAAPPATDRRRDGFARRSGQAVIELLRRGITARDILTKEAFENAIAVVMAFGGSTNAILHLLAIAHEADVTLSLEDFSRIGFKVPHIADVKPFGRHVMFDVDHIGGVPVVMKALLDAGLLHGDCLTVTGQTMAENLASIAPPDPDGQVIRTLHNPIHPTGGITILRGSLAPDGAVVKTAGLDSDVFEGTARVFDGERAALDALKDGTIAKGDVVVIRYEGPKGGPGMREMLAITGAIKGAGLGKDVLLLTDGRFSGGTTGFCVGHIAPEAVEAGPIAFLRDGDRVLLDVVGCSLDVLVDPVEFSSRKKDFIPPAPRYTTGVLAKYVKLVSSATVGAVCG

SEQ ID NO: 21 - DNA, 1692 bp, Kineococcus radiotolerans
gtgagcgtcgacatcaagccccgcagtcgccaggtcaccgacggtctggaggcgaccgcctcgcgcggcatgctccgcgccgtcggcatgggcgacgacgactgggagaagccccagatcggggtggcctccagctggaacgagatcaccccctgcaacctgtccctggaccgcctcgcgaaggccgtcaaggacggcgtgcactccgcccacggcttcccgatggagttcggcaccatctccgtctccgacggcatctcgatgggccacgaggggatgcactactccctcgtctcgcgcgaggtcatcgccgactccgtcgagaccgtcatgagcgccgagcgcctcgacgggtccgtcctgctcgccggctgcgacaagtccctgccggggatgctcatggccgccgcgcgcctggacctggccagcgtcttcctctacgccggcacgatcctgcccgggcgggccaagctgtccgacggcagcgagcacgaggtcaccctcatcgacgccttcgaggccgtcggggcgtgcgcgcgggggctgatgtcccgcgaggacgtcgacgtcatcgagcgcgccatctgccccggcgagggggcctgcgggggcatgtacaccgcgaacacgatggccgccgcggccgaggcgctggggatgtccctgcccggcagcgcggccccgcccgcgaccgaccgccgtcgcgacgggttcgcccgccgctccggcgaggccgtggtgaacctgctctcgaagggcatcaccgcccggcagatcctcaccaaggaggcgttcgagaacgccatcgccgtcgtcatggccctgggcggctccaccaacgccgtcctgcacctgctggccatcgcctacgaggccgaggtcgacctcaccctcgccgacttcgaccgcgtcgccgcgaaggtcccgcacctggccgacctcaagcccttcggccgccacgtcatggtcgacgtcgaccgcatcggcggcatccccgtcgtcatgcgcgcgctgctggacgcgggcctgctgcacggggactgcctgacggtgaccgggaggacgatggccgagaacctcgccgacatcgccccgcccgacgtcgacggcgtcgtgctgcgctcgctgcaggaccccatccacaagaccggcggcatcacgatcctctccggcaacctcgcccccggcggcgcggtggtgaagagcgcgggcttcgactccgacgtcttcgagggcaccgcgcgggtcttcgagcgcgagcgcgccgccctggacgccctggaggacggcacgatctccgccggcgacgtcgtcgtcatccgctacgagggccccaagggcggcccggggatgcgcgagatgctcgccatcaccggcgcgatcaagggcgcgggcctgggcaaggacgtgctgctcatgaccgacgggcgcttctccggcgggacgacgggcctgtgcgtggggcacgtggcccccgaggccgtcgacgccggtcccatcgcgttcgtgcgcgacggggaccggatccgcctggacgtcgccggcaagaccctcgaggtgctggtggacgaggaggagctcgccgcccgccgcgagggctgggagccgctgcccccggtcttcaagcgcggggtgctggccaagtacgccaagcaggtccagtccgcctcgctcggggccgtctgccgctga

SEQ ID NO: 22 - protein, 563 aa, Kineococcus radiotolerans
MSVDIKPRSRQVTDGLEATASRGMLRAVGMGDDDWEKPQIGVASSWNEITPCNLSLDRLAKAVKDGVHSAHGFPMEFGTISVSDGISMGHEGMHYSLVSREVIADSVETVMSAERLDGSVLLAGCDKSLPGMLMAAARLDLASVFLYAGTILPGRAKLSDGSEHEVTLIDAFEAVGACARGLMSREDVDVIERAICPGEGACGGMYTANTMAAAAEALGMSLPGSAAPPATDRRRDGFARRSGEAVVNLLSKGITARQILTKEAFENAIAVVMALGGSTNAVLHLLAIAYEAEVDLTLADFDRVAAKVPHLADLKPFGRHVMVDVDRIGGIPVVMRALLDAGLLHGDCLTVTGRTMAENLADIAPPDVDGVVLRSLQDPIHKTGGITILSGNLAPGGAVVKSAGFDSDVFEGTARVFERERAALDALEDGTISAGDVVVIRYEGPKGGPGMREMLAITGAIKGAGLGKDVLLMTDGRFSGGTTGLCVGHVAPEAVDAGPIAFVRDGDRIRLDVAGKTLEVLVDEEELAARREGWEPLPPVFKRGVLAKYAKQVQSASLGAVCR

SEQ ID NO: 23 - DNA, 1704 bp, Janibacter sp.
atgagcaagcccgacatcgacatcaagccccgtagccgcgacgtcaccgacggtctcgagaagaccgcggcccgaggaatgctccgtgccgtaggcatgggcgacgacgactgggtcaagccacagatcggtgtcgcgagctcctggaacgagatcaccccctgcaacctctctctcgaccgcctgtccaaggcagtcaaggacggcgtccacgctgccggtggctacccgctcgagttcggcacgatctcggtgtccgacggcatctcgatgggccacgagggcatgcacttctcgctcgtgtcgcgcgagatcatcgccgactccgtcgagaccgtcatgagtgccgagcgcctcgacggctcggtcctgctcgccggctgcgacaagtccctcccgggcatgctcatggctgcggcgcgcctcgacctcgcctcggtcttcctgtatgccgggtcgatccttcccgggatcgcgaagctctcggacggcaccgagaaggaggtcacgatcatcgacgccttcgaggccgtcggtgcagccaacgcgggcaagatgtcgctggccgacgtcgacgccatcgagcgcgcgatctgtccgggggagggcgcctgtggcggtttctacacggccaacaccatggctgcggtcgccgagtcgatcggcatgtccatcccgggttcggccgccccgccagccaccgaccgacgccgcgacgtgcacgcccgccgctccggtgaggccgtcgtcgagctcctgcgtcgcggcatcaccgcccgccagatcatgaccaagcccgcgttcgagaacgccatcgccgtcgtcatggccttcggtggctcgaccaacgccgtcctccacctgctcgccatggcccacgaggccgaggtcgacctcaccatcggcgacttccagcgcatcggcaaaaaggtcccgcacctcgccgacgtcaagccgttcggcgccttcgtcatgaaggacatcgaccacatcggtggcatccccgtcgtcatgaagtcgctgctcgaggccgacctcctcgatggcgacgcactcaccgtgaccggcaagaccgtcgccgagaacctcgacgagatcaagccgccgcacatcgacggtcgcgtgatccgcgagttcagcaacccgatccacaagaccgggggcctcaccatcctcaccggctccctcgcgcccgaaggtgcggtcgtgaagtcggccggattcgacaccgaggtcttcgagggcagcgcccgcgtcttcaacggcgagcgtgccgcgatggatgccgtcgagcagggtgccctcaagccccaggacgtcgtcgtcatccgctacgaagggcccaagggtggcccgggaatgcgcgagatgctcgccgtcaccggcgccatcaagggcgcgggtctcggcaaggacgtcctcctcctcaccgacggtcgcttctccggtggcacgaccggcctctgcgtcggacacgtggcccccgaggccgtcgacgagggccccatcgccttcgtccgtgacggagacggcatccgcctcgacgtcgcgaacggcactcttgacctcctcgtcgacgacgccgagctcgagcgccgccgcaccgagggcgtcacccatcccgagcccaagtacacccgcggcgtgctcgcgaagtaccgcaagctcgtcggctcggccagcaagggcgccgtctgcgactga

SEQ ID NO: 24 - protein, 567 aa, Janibacter sp.
MSKPDIDIKPRSRDVTDGLEKTAARGMLRAVGMGDDDWVKPQIGVASSWNEITPCNLSLDRLSKAVKDGVHAAGGYPLEFGTISVSDGISMGHEGMHFSLVSREIIADSVETVMSAERLDGSVLLAGCDKSLPGMLMAAARLDLASVFLYAGSILPGIAKLSDGTEKEVTIIDAFEAVGAANAGKMSLADVDAIERAICPGEGACGGFYTANTMAAVAESIGMSIPGSAAPPATDRRRDVHARRSGEAVVELLRRGITARQIMTKPAFENAIAVVMAFGGSTNAVLHLLAMAHEAEVDLTIGDFQRIGKKVPHLADVKPFGAFVMKDIDHIGGIPVVMKSLLEADLLDGDALTVTGKTVAENLDEIKPPHIDGRVIREFSNPIHKTGGLTILTGSLAPEGAVVKSAGFDTEVFEGSARVFNGERAAMDAVEQGALKPQDVVVIRYEGPKGGPGMREMLAVTGAIKGAGLGKDVLLLTDGRFSGGTTGLCVGHVAPEAVDEGPIAFVRDGDGIRLDVANGTLDLLVDDAELERRRTEGVTHPEPKYTRGVLAKYRKLVGSASKGAVCD

SEQ ID NO: 25 - DNA, 1704 bp, Nocardioides sp.
atgaccgagcccacctcccgccccgacatcaagccccgctcccgcgacgtcaccgacggcctggagaaggccgccgcgcgcggcatgctgcgggcggtaggcatgggcgacgaggacttcgcgaagccgcagatcggcgtgggctcgagctggaacgagatcaccccgtgcaacctgtccctggaccggctcgccaaggccgtgaagaacggcgtgcacgcggccggcggctacccgctggagttcggcaccatctcggtctccgacggcatctccatgggccacgagggcatgcacttctcgctggtctcccgcgaggtgatcgccgactcggtcgagaccgtgatgatggccgagcgcctggacggctcggtgctgctcgccggctgcgacaagtcgctgccgggcatgatgatggccgccgcccgcctcgacctggccagcgtgttcctctacgccggctcgacgatgcccgggcaggtggacggcaacgacgtcacgatcatcgacgcgttcgaggccgtcggggcgtgcctggccggcaagatcagccgcgacgaggtggaccggatcgagcgggccatctgtccgggcgagggcgcctgcggcggcatgtacaccgcgaacacgatggcctccatcgccgaggcgatcggcatgtcgctccccggctcggcggccccgccggcggtcgatcgccgacgcgacggcttcgcgcaccgctcgggggaggccgtggtcaacctgttgcgccagggcatcacggcccgccagatcatgactcgcgcggcgttcgagaacgcgatcacggtcgcgatggcgctcggcggctcgaccaacgccgtgctccacctgctcgcgatggctcgtgaggccgacgtcgacctcaccatcgacgacttcaaccggatcggtgacaaggtgccgcacctcggcgacctcaaaccgttcggcaagtacgtcatgaacgacgtcgacaagatcggcggcatccccgtcgtgatgaaggcactgctcgacgccggtctgatgcacggcgacgcgctcaccgtcaccggcaagaccctggccgagaacctcgccgagctggccccgccggagctcgatgacgaggtgatccgcaagctggaccggccgatccacaagaccggtgggctcacgatcctcaagggctcgctcgctcccgagggcgccgtggtcaagacggccggcttcgacgactccgtgttcaccggcaccgcccgcgtcttcgacggcgagcgggccgcgatggacgccctcgaggccgggcagatccagccccgcgacgtcgtggtgatccgctacgagggcccgaagggtggccccggcatgcgcgagatgctcgcgatcaccggcgcgatcaagggcgccggcctcggcaaggacgtcttgctgatcaccgacggcaggttctccggtggtacgacgggcctgtgcgtgggccacatcgcccccgaggccgtcgacggcggcccgatcgcgttcgtccgcgacggcgaccagatcaccctcgacgtcgccaaccggctgctcgaggtggaggtcgtcggtcccgatgccgaggccgagtgggagcgccgcaaggtcggctgggagccgaatccgcccaagtacacccgcggggtgctcggcaagtacgccaagatcgtccagtccgccgcgcacggcgccatcaccggctga

SEQ ID NO: 26 - protein, 567 aa, Nocardioides sp.
MTEPTSRPDIKPRSRDVTDGLEKAAARGMLRAVGMGDEDFAKPQIGVGSSWNEITPCNLSLDRLAKAVKNGVHAAGGYPLEFGTISVSDGISMGHEGMHFSLVSREVIADSVETVMMAERLDGSVLLAGCDKSLPGMMMAAARLDLASVFLYAGSTMPGQVDGNDVTIIDAFEAVGACLAGKISRDEVDRIERAICPGEGACGGMYTANTMASIAEAIGMSLPGSAAPPAVDRRRDGFAHRSGEAVVNLLRQGITARQIMTRAAFENAITVAMALGGSTNAVLHLLAMAREADVDLTIDDFNRIGDKVPHLGDLKPFGKYVMNDVDKIGGIPVVMKALLDAGLMHGDALTVTGKTLAENLAELAPPELDDEVIRKLDRPIHKTGGLTILKGSLAPEGAVVKTAGFDDSVFTGTARVFDGERAAMDALEAGQIQPRDVVVIRYEGPKGGPGMREMLAITGAIKGAGLGKDVLLITDGRFSGGTTGLCVGHIAPEAVDGGPIAFVRDGDQITLDVANRLLEVEVVGPDAEAEWERRKVGWEPNPPKYTRGVLGKYAKIVQSAAHGAITG

SEQ ID NO: 27 - DNA, 1722 bp, Renibacterium salmoninarum
atgagtgtggaaaccagtagcgaaaccggcaacaaaccagatatcaaaccgagaagccgcattgtcaccgacggaattgccgccgcgcctgctcgaggaatgctccgagccgttggctttggcgacgaggactttgcgaagccgcagattggcgtcgcgagttcgtggaacgaaattaccccctgcaatctctcccttgatcggctggccaaagccgtcaaagagggcgtgcatgccggcggcggcttcccgatgatctttggcacaatttcggtgtccgatggcatttcgatggggcacgaaggtatgcacttctcgcttgtctcccgcgaagtgattgctgactcggtagagactgttatgcaagcagaacgcatcgatggctcggtgctgcttgctggctgcgataagtcattgccgggcatgttgatggccgcagcccggctcaatgtgtccagtgttttcctctacgccggctcaatcatgcccggctgggtcaagcttgaagacggcacagagaaagacgtcacgcttattgacgcctttgaagctgtcggtgcctgcgcagccggcaaaatgtcggtgggggatctagaccgaatcgaacgggcaatttgtccgggcgaaggtgcctgcggtggtatgtacaccgcgaacactatggcctgtattggcgaggccttgggtatgtccttgcctggctcggctgcgccgccaagtgcggaccgccgtcgcgatatgttcgcgcaccgttctggcgaggctgttgttgagttgctccgccggggcattcgctcgcgcgacatcatgaccaaggaagcctttgagaacgcgattgcggtcacgatggcttttggcggctccacgaacgcagtgctgcacctacttgctattgctcgtgaggccgaggttgatctgcagcttgaggacttcaaccgaattggtgacaagatcccgcacctcggcgacctcaagccttttggccgatacgtgatgaacgacgtcgaccgggtgggcggcgtgccggtgataatgcgcgcgctgctcgatgccgggctactgcatggtgatgccttgaccgtgaccggtaagactctggccgaaaatcttgaagcgatcaatccgccagatctggatggcaagattttgcgtgcgttggataatccaatccacaaaactggtgggttgagtgtgctcaagggctcgcttgcacctggcggcgccgtggttaagaccgccgggttcgacgccgaggttttcgaaggcccggctcgggtttttgaacgcgaacaaggcgcactcgaagcgcttaaggctggcgaaatcaaagcgggcgacgtcgtcgtgatccgctatgaaggccctaaaggtgggccgggtatgcgcgaaatgctcgccatcactggcgcgatcaagggcgctggcctgggcaaagacgtgttgttgttgaccgacggtcggttctccggaggtacaacgggtctgtgcatcgggcacgtggcgccggaagctgtcgacgccgggccaatcgcctttgtgcaagacggcgacctaatccgggttgatatccccaacaagagtttcgatctcttggttgacgaagcagagctggaagctcggaaaatcggttgggagccgttgcctgctcgcttcactaaaggcgtgttggctaagtacgctaagcttgtgcactcggcttccgaaggcgcatactgcggctaa

SEQ ID NO: 28 - protein, 573 aa, Renibacterium salmoninarum
MSVETSSETGNKPDIKPRSRIVTDGIAAAPARGMLRAVGFGDEDFAKPQIGVASSWNEITPCNLSLDRLAKAVKEGVHAGGGFPMIFGTISVSDGISMGHEGMHFSLVSREVIADSVETVMQAERIDGSVLLAGCDKSLPGMLMAAARLNVSSVFLYAGSIMPGWVKLEDGTEKDVTLIDAFEAVGACAAGKMSVGDLDRIERAICPGEGACGGMYTANTMACIGEALGMSLPGSAAPPSADRRRDMFAHRSGEAVVELLRRGIRSRDIMTKEAFENAIAVTMAFGGSTNAVLHLLAIAREAEVDLQLEDFNRIGDKIPHLGDLKPFGRYVMNDVDRVGGVPVIMRALLDAGLLHGDALTVTGKTLAENLEAINPPDLDGKILRALDNPIHKTGGLSVLKGSLAPGGAVVKTAGFDAEVFEGPARVFEREQGALEALKAGEIKAGDVVVIRYEGPKGGPGMREMLAITGAIKGAGLGKDVLLLTDGRFSGGTTGLCIGHVAPEAVDAGPIAFVQDGDLIRVDIPNKSFDLLVDEAELEARKIGWEPLPARFTKGVLAKYAKLVHSASEGAYCG

SEQ ID NO: 29 - DNA, 1767 bp, Arthrobacter aurescens
gtgcaacagcgtcggcagtcgcccggtagacatagactttggaccatgagtgacaccacccagattgcgacagacagcacgccggacattaaaccccgcagccgggtggtgacagacggcattcacgcggcgcctgcccgcggcatgttccgtgcggtgggcatgggcgacgacgactttgccaaaccccaaatcggtgttgccagctcgtggaatgaaattaccccttgcaatctttccctgaatcgcctcgcacaaggcgccaaggaaggcgtccatgccggcggcggcttcccgatgcagttcggcacgatctccgtttcggatggtatttccatgggccacgagggcatgcacttctccctggtctcccgcgaagtcatcgccgactctgtggaaacagtgatgcaggccgagcgcattgacggctcggtgctcctggccggctgtgacaagtcccttccgggcatgctcatggctgctgcccgcttggacctcgcatccgtcttcctctacgccggctccatcatgccgggctgggtcaagctggaggacggctcggagaaggaagtcaccctcattgatgccttcgaggccgtgggtgcctgcgccgccggcaaaatgagcatggaagacctcacaaggatcgaaaaggccatctgtcccggcgaaggcgcctgcggcggtatgtacacggccaacaccatggcgtgcatcggcgaggccttgggcatgtccctcccgggttcagccgccccgccgtcggcagaccgccgtcgtgatgatttcgcacgcaagtccggcgaagccgtagtaaacctgctgcgcctgggcatcacggcccgcgacatcatgaccaaaaaggcgttcgagaatgccattgccgtcaccatggccttcggcggttccaccaacgccgtgctgcacttgctcgcgatcgcccgggaagccgaagtagagctgacgctggacgacttcaatcgcatcggcgacaaaattccgcaccttggggacctcaagcccttcggccgttatgtgatgaccgacgttgacaagatcggcggcgtgccggtcatcatgaaggcactgctcgacgccggactactgcacggcgactgcctcaccgttaccggcaagacgctcgcggaaaacctcgcctcgatcaacccgccggaccttgacggcaaaatcctccgtgcgctggacaacccgatccacaagaccggtggcatcaccatcctccacggctctatggctccggaaggagcggtagtgaagagtgccggttttgatgctgacgtctttgaaggaactgcacgcgttttcgaacgcgagcagggcgccctcagcgcgttggacaacggcgaaatcaacaagggagacgtagtggtcatccgctatgaaggccccaagggcggtcccggcatgcgggaaatgttggccatcaccggcgccatcaagggagcgggactcggcaaggatgtcctccttctcacggatggccggttctcgggtggcacaacgggtctgtgcatcggccacgttgcgcctgaagccgtggatggtggccccatcgcgttcgtgaaggacggtgaccgcatccgtgtagacatcgccgctcgctccttcgacctcctggtggacgaagccgagctcgaagcccgcaaagagggctggaagccactgcccgccaagttcaccaagggtgttcttgccaagtacgccaagcttgtccacagcgcctccaccggagcgtactgcggataa

SEQ ID NO: 30 - protein, 588 aa, Arthrobacter aurescens
MQQRRQSPGRHRLWTMSDTTQIATDSTPDIKPRSRVVTDGIHAAPARGMFRAVGMGDDDFAKPQIGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLDLASVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRLGITARDIMTKKAFENAIAVTMAFGGSTNAVLHLLAIAREAEVELTLDDFNRIGDKIPHLGDLKPFGRYVMTDVDKIGGVPVIMKALLDAGLLHGDCLTVTGKTLAENLASINPPDLDGKILRALDNPIHKTGGITILHGSMAPEGAVVKSAGFDADVFEGTARVFEREQGALSALDNGEINKGDVVVIRYEGPKGGPGMREMLAITGAIKGAGLGKDVLLLTDGRFSGGTTGLCIGHVAPEAVDGGPIAFVKDGDRIRVDIAARSFDLLVDEAELEARKEGWKPLPAKFTKGVLAKYAKLVHSASTGAYCG

SEQ ID NO: 31 - DNA, 1695 bp, Leifsonia xyli
atgcctcagatcgattggaaaccgcgttcgcgcgttgtcacggacgggatcgaagccaccacgagccgcgggatgctccgtgcggtcggcatgggggacgccgactgggagaagccgcagatcggcatcgcctcgtcctggaacgagatcacgccgtgcaacctctcgctcgaccggctggcccagggcgccaaagaaggcgtccactccggtggcggttatccgctgcaattcggtaccgtctcggtctccgacggtatctcgatggggcacgagggaatgcacttctcgctcgtctcccgtgaggtcatcgccgactcggtcgagacggtcatgatggccgagcggctcgacggcaccgtcctcctcgccggctgcgacaaatcgctgccgggcatgctgatggccgcggcccgtctcgacctctccgcgatcttcctctacgcgggctccatcgcgcccggctgggtcaaactcagcgacggcaccgagaaggacgtcacgatcatcgactcgttcgaggctgtcggtgcgtgcaaggccggcaagatgagcgaggaggacctcaaacgcatcgagtgcgccatagccccgggtgaaggagcctgcggcggcatgtacaccgcgaacaccatggcgtccgtcgccgaggcactcgggatgagcctgcccggctcggctgcgccgccctcggccgaccggcggcgcgactccttcgcccaccgctccggcgaggctgttgtctccctgctgaagcagggcatcacggctcgcgacatcctcaccaagaaggcgttcgagaacgccatcgcggtggcgatggccttcggcgggtcgacgaacgtcgtgcttcacctgctcgccatcgcgcgcgaggccgaggttgacctcaccatcgacgatttcaaccgcatcggcgagacggttccgcacatcggcgatctcaaaccgttcggcacgtacgtcatgaacgacgtcgaccgtcacggtggtgtcccggtcgtcatgaaggcgctcctggacgcgggcctgctgcacggggactgcctcaccgtgaccggcaagaccgtcgcggagaacctggcggagatcgacccgcccgcaccggacggcaccgtcctgcgctcgctggacaaccccatccacccgacaggggggctcacaatcctcaagggcacgctcgctccggagggcgccgttgtcaagacggctggtttcgacgccgaggtgttcgagggcccagcgcgcgtgttcgagcgcgagcgcgccgctatggacgctctcaccgcgggccggatcaacgccggcgatgtggtcgtcatctgctacgaagggccgaagggcggtcccgggatgcgcgagatgctcgcgatcaccgccaccatcaagggtgcaggcctcggcaaggatgtactactcttgacggacgggcgattctcaggcggcacaaccggcctgtgcatcggccacatagcacccgaagcggtggacgctggtcccatcgcattcgtgcgcgatggtgatttgatacgggtcgatatcgcggctcgctccctcgacctactggtcgacgagtcagagctgaccgcccgccgggacggctgggcgcctcttcctccgcgctatacccgtggcgttctcgcgaagtactccaagctcgttcgctccgctgcggagggtgcggtcaccgggtag

SEQ ID NO: 32 - protein, 564 aa, Leifsonia xyli
MPQIDWKPRSRVVTDGIEATTSRGMLRAVGMGDADWEKPQIGIASSWNEITPCNLSLDRLAQGAKEGVHSGGGYPLQFGTVSVSDGISMGHEGMHFSLVSREVIADSVETVMMAERLDGTVLLAGCDKSLPGMLMAAARLDLSAIFLYAGSIAPGWVKLSDGTEKDVTIIDSFEAVGACKAGKMSEEDLKRIECAIAPGEGACGGMYTANTMASVAEALGMSLPGSAAPPSADRRRDSFAHRSGEAVVSLLKQGITARDILTKKAFENAIAVAMAFGGSTNVVLHLLAIAREAEVDLTIDDFNRIGETVPHIGDLKPFGTYVMNDVDRHGGVPVVMKALLDAGLLHGDCLTVTGKTVAENLAEIDPPAPDGTVLRSLDNPIHPTGGLTILKGTLAPEGAVVKTAGFDAEVFEGPARVFERERAAMDALTAGRINAGDVVVICYEGPKGGPGMREMLAITATIKGAGLGKDVLLLTDGRFSGGTTGLCIGHIAPEAVDAGPIAFVRDGDLIRVDIAARSLDLLVDESELTARRDGWAPLPPRYTRGVLAKYSKLVRSAAEGAVTG

SEQ ID NO: 33 - DNA, 1704 bp, Marine actinobacterium
atgtctgagagtgattcgattgatatcaagccacgttcccgcacggtaaccgacggaattgaagcaacaacttcgcgcggaatgctgcgtgcagttggtatgggagatgccgactgggagaagccccagatcggtattgcgagctcgtggaacgagatcaccccctgcaatctgtcgctcgatcgcctcgctcaagcggcgaaagagggagtgcacgccggtggcgggtacccactgcagtttggaacgattagcgtttccgatggcatttcaatggggcacgaggggatgcacttctcactcgtgagtcgcgaagttatcgctgactccgttgaggttgtcatggaggcagagcgcctcgacggttcggtcacgctcgcgggctgcgacaagtcgcttcccggaatgctgatggctgcggcgcggctcaacctcgcctctgtcttcctctatgccggttcgatcgctcccggctgggtcaagctcagcgacggtaccgaaaaagacatcacgatcatcgactcgttcgaagcagtcggcgcagtcaaagctggccggatgagcgaagccgacgccaagcgcatcgagtgtgcttttgcgcccggcgagggtgcctgtggcggtatgtacacggccaacacgatggcgagcgttgcggaagccctgggaatgagtcttcccggctcggcgagcccagcatccgccgatcgtcgtcgcgactacttcgcgcaccgttcaggcgaagctgtcgtcaatcttctgcgcctcggtatcacttcgcgcgacatcatgacgaagaaggcttttgagaacgcgatcacggtagcaatggctcttggtggctccacgaacgttgtgctgcacatcctcgccatcgcgagcgaagccgaagttgaactcacgctcgatgacttcaatcgcatcggcgacaaggttccccacttgggcgacctgaagccgttcggccagtacgtcatgaacgatgttgaccgccacggcgggctcccggtgctcatgaaggcgctcatggaggaggggctcattcacggcgatgccctcacagtgacgggcaagactgttgccgaaaacttggccgagatggacatcgatcctctagatggcaaggttcttcgcaagttcgacaaccccatccaccccactgggggtctcacaattcttaagggttctttcgctcccgagggtgcagtcgtgaagacggcaggtttcgacgttgctgagttcgtgggccctgcccgcgtgttcgagcgcgagcgtgaagcactggatgctttgactgccggcacgatcgaggctggttctgttgtcgtcattcgctatgaaggacccaagggtggaccgggcatgcgcgagatgctcgcgatcacggcggccatcaagggcgctggactcggcaaagatgtactactcttaacagacggacgattctcaggcggcacaaccggactgtgtatcggccacatagctcccgaagcagtagacgcaggtcctattgccttcgtgcgcgatggtgatcttatacgggtcgatatcgcagctcgctcgctcgacttacttgtcgactccgctgagctcgaagcccgccgaaaaggctgggcccccctccctccgcgctacacgcgaggtgttctggccaagtattcgaagcttgttcagtccgccgctcgcggcgcggtcaccagttag

SEQ ID NO: 34 - protein, 567 aa, Marine actinobacterium
MSESDSIDIKPRSRTVTDGIEATTSRGMLRAVGMGDADWEKPQIGIASSWNEITPCNLSLDRLAQAAKEGVHAGGGYPLQFGTISVSDGISMGHEGMHFSLVSREVIADSVEVVMEAERLDGSVTLAGCDKSLPGMLMAAARLNLASVFLYAGSIAPGWVKLSDGTEKDITIIDSFEAVGAVKAGRMSEADAKRIECAFAPGEGACGGMYTANTMASVAEALGMSLPGSASPASADRRRDYFAHRSGEAVVNLLRLGITSRDIMTKKAFENAITVAMALGGSTNVVLHILAIASEAEVELTLDDFNRIGDKVPHLGDLKPFGQYVMNDVDRHGGLPVLMKALMEEGLIHGDALTVTGKTVAENLAEMDIDPLDGKVLRKFDNPIHPTGGLTILKGSFAPEGAVVKTAGFDVAEFVGPARVFEREREALDALTAGTIEAGSVVVIRYEGPKGGPGMREMLAITAAIKGAGLGKDVLLLTDGRFSGGTTGLCIGHIAPEAVDAGPIAFVRDGDLIRVDIAARSLDLLVDSAELEARRKGWAPLPPRYTRGVLAKYSKLVQSAARGAVTS

SEQ ID NO: 35 - DNA, 1695 bp, Clavibacter michiganensis
atgcctgagatcgacatgaagccccggagccgcgacgtcaccgacgggatcgaggccaccgcagcacgcggcatgctccgcgccgtcgggatgggcgacgaggactgggcgaagccccagatcggcgtcgcgagctcctggagcgagatcaccccctgcaacctcagcctcgaccgcctcgcgcagggcgccaaggagggcgtgcacgcgggcggcggctacccgctccagttcggcaccatctccgtcagcgacggcatctcgatgggccacgagggcatgcacttctcgctcgtctcgcgcgaggtcatcgccgacagcgtcgagaccgtcatgatggccgagcgcctcgacgggtccgtgctcctcgcgggctgcgacaagtcgctccccggcatgctcatggccgcggcccgcctcgacctctcctcggtgttcctctacgcgggatccatcgcccccggctgggtcaagctctcggacggcaccgagaaggaggtcaccatcatcgacgccttcgaggcggtcggcgcctgcaaggccggcacgatgagccaggaggacctgacccgcatcgagaaggccatctgcccgggcgagggcgcatgcggcggcatgtacacagcgaacaccatggcgagcgtggccgaggccctcggcatgagcctccccggatccgccgccccgccgagcgccgaccgccgccgcgactacttcgcgcaccggtcgggcgaggccgtcgtcaacctcatcgcggagggcatcaccgcgcgcgacatcatgacgaaggaggcgttcgagaacgccatctccgtggtcatggcgttcggcggatccaccaacgcggtcctccacctcctcgccatcgcgcgcgaggccgaggtcgacctgcagctgtccgacttcaaccgcatcgccgaccgcgtgccgcacctcggcgacctcaagccgttcggccgcttcgtcatgaacgacgttgaccgcgtcggcggcgtccccgtcgtcatgaaggccctgctcgacgcgggcctcctgcacggcgacgtcatgaccgtcaccggccgcaccatgcgcgagaacctcgaggcgatggacctcgcggagctcgacggcacggtcatccggaagatggacgacccgatccacgccaccggcggcatcagcgtcctgcacggctccctcgcccccgagggcgcggtcgtgaagacggccggcttcgacctcgacgtgttcgagggccccgcccgcgtcttcgagcgcgagcgcgccgcgatggacgcgctcaccgagggactcatctcgaagggcgacgtcatcgtcatccgctacgagggccccaagggcggccccggcatgcgcgagatgctcgccatcacgggcgccatcaagggagccggcctcggcaaggatgtactactcttgacggacggtcgattctcaggcggcacaaccggactgtgcatcggccacatggctcccgaagcggtggacgcaggtcccgtcgccttcgtgcgcgatggagaccggatccgtgtcgacatcgccgctcgcacgctcgacctactggtcgacgaggccgagctcgccgcccgccgtgaggggtgggcacctctcccgccgcgctacacgcgcggggtcctcgccaagtacgccaagctcgtgcactcggccgccgagggcgcgatcacgggatga

SEQ ID NO: 36 - protein, 564 aa, Clavibacter michiganensis
MPEIDMKPRSRDVTDGIEATAARGMLRAVGMGDEDWAKPQIGVASSWSEITPCNLSLDRLAQGAKEGVHAGGGYPLQFGTISVSDGISMGHEGMHFSLVSREVIADSVETVMMAERLDGSVLLAGCDKSLPGMLMAAARLDLSSVFLYAGSIAPGWVKLSDGTEKEVTIIDAFEAVGACKAGTMSQEDLTRIEKAICPGEGACGGMYTANTMASVAEALGMSLPGSAAPPSADRRRDYFAHRSGEAVVNLIAEGITARDIMTKEAFENAISVVMAFGGSTNAVLHLLAIAREAEVDLQLSDFNRIADRVPHLGDLKPFGRFVMNDVDRVGGVPVVMKALLDAGLLHGDVMTVTGRTMRENLEAMDLAELDGTVIRKMDDPIHATGGISVLHGSLAPEGAVVKTAGFDLDVFEGPARVFERERAAMDALTEGLISKGDVIVIRYEGPKGGPGMREMLAITGAIKGAGLGKDVLLLTDGRFSGGTTGLCIGHMAPEAVDAGPVAFVRDGDRIRVDIAARTLDLLVDEAELAARREGWAPLPPRYTRGVLAKYAKLVHSAAEGAITG

SEQ ID NO: 37 - DNA, 1707 bp, Saccharopolyspora erythraea
gtgagcaccagcactgatggcacaggacagtcggggcgtggtctgaagccccgcagcggtgacgtgaccgaggggatcgaacgtgctgcggcgcgggggatgctccgggcggtcgggatgcaggacgccgacttcgcgaagccccagatcggggtggcgtcctcgtggaacgagatcacgccgtgcaacctgtcgttgcagcggctcgcgcaggcgagcaaggaaggtgtgcacgcggccggcggcttcccgatggagttcgggacgatctcggtctcggacgggatctcgatgggtcacgtcggcatgcactactcgctcgtgtcccgcgaggtcatcgccgactccgtcgagacggtgatggaggcggagcggctcgacgggtccgtgctgctcgccggctgcgacaagagcctgccgggcatgctgatggccgcggcgcgcctggacgtcgcggcggtcttcgtctacgccgggtcgatcctccccgggcgggtcgacgaccgcgaggtcaccatcatcgacgcgttcgaggcggtgggcgcctgcgcccgcggcctgatcagcgaggccgaggtcgaccgcatcgaacgcgccatctgcccgggagagggcgcgtgcggcggcatgtacaccgcgaacaccatggcctgcgcggcagaggcgatgggcatgtcgctgccgggatcggcgagcccgccgtcggtagaccggcggcgcgacgccggagcccgggaggccgggcgcgcggtggtcgggatgatcgagcgcggactgaccgcgcggcagatcctgaccaaggaggcgttcgagaacgccatcgccgttgtgatggcgttcggtggctccaccaatgccgtgctgcacctgttggcgatcgcgcgggaagccgaggtcgacctgacgctcgacgacttcaaccgcatcggtgaccgcgtcccgcacctcgccgacgtcaagcccttcggtcggcacgtgatgaccgcggtggaccggatcggtggcgtgccggtcgtgatgaaggccctgctcgacgccgggttgctgcacggcgactgcatgacggtcaccgggaagacggtggccgagaacctcgccgagctggatccgccggagctcgacggtgaggtcctgcacaagctgtcgaacccgctgcacccgaccggcgggctgacgattctgcgcggatcgctcgccccggaaggtgcggtggtcaagagcgccgggttcgactccgccactttcgaaggcacggcgcgggttttcgacggcgagcagggtgcgatggacgccgtcgaagacggctcgttgaaggccggcgacgtggtggtgatccggtacgaagggccgcgcggtggtccgggtatgcgcgagatgctcgcggtcaccggtgccatcaagggcgcgggcctgggcaaggacgtcctgctgctgacggacggccgtttctccggcggtaccacggggctgtgcatcggtcacgtggctcccgaggcgaccgacggcgggccgatcgcgttcgtgcgcgacggggacccgatccggctcgacctggcgggccggacgctcgacctgctggtggacgaagccgaactcgcgcgccggaaggaaggctgggtgccgcgggagccgaagttccggcagggcgtgctcgggaagtacgcgcggctggtccggtcggcggcggtgggcgcggtctgctcctga

SEQ ID NO: 38 - protein, 568 aa, Saccharopolyspora erythraea
MSTSTDGTGQSGRGLKPRSGDVTEGIERAAARGMLRAVGMQDADFAKPQIGVASSWNEITPCNLSLQRLAQASKEGVHAAGGFPMEFGTISVSDGISMGHVGMHYSLVSREVIADSVETVMEAERLDGSVLLAGCDKSLPGMLMAAARLDVAAVFVYAGSILPGRVDDREVTIIDAFEAVGACARGLISEAEVDRIERAICPGEGACGGMYTANTMACAAEAMGMSLPGSASPPSVDRRRDAGAREAGRAVVGMIERGLTARQILTKEAFENAIAVVMAFGGSTNAVLHLLAIAREAEVDLTLDDFNRIGDRVPHLADVKPFGRHVMTAVDRIGGVPVVMKALLDAGLLHGDCMTVTGKTVAENLAELDPPELDGEVLHKLSNPLHPTGGLTILRGSLAPEGAVVKSAGFDSATFEGTARVFDGEQGAMDAVEDGSLKAGDVVVIRYEGPRGGPGMREMLAVTGAIKGAGLGKDVLLLTDGRFSGGTTGLCIGHVAPEATDGGPIAFVRDGDPIRLDLAGRTLDLLVDEAELARRKEGWVPREPKFRQGVLGKYARLVRSAAVGAVCS

SEQ ID NO: 39 - DNA, 1677 bp, Acidothermus cellulolyticus
atgcgcgctcagcccgatctcaaaccgcgcagccgtgacgtcaccgatgggctggagcgggccgcggcccgcggcatgctccgcgccgtcggaatgaccgatgcggactgggagaaaccccagatcggagtggcgagttcctggaacgagataacgccctgcaacctctccctcgaccggctcgcgcaggcggccaaggagggcgtgcacgccgccggcgggtatccgctggagttcgccaccatctcggtttccgacggcatctccatgggccatgagggaatgcatttctcgctgatttcccgcgaagtcatcgccgattccgtcgaaaccgtcttcatggctgagcgcttcgacggcgccgtcctgcttgccggttgcgacaagtccgaacccggcatgctgatggcggccgcccggcttgacctggcagcggttttcctctatgccggcagcacgttgccggggaaactcggggaccgggacatcaacatcgtcgatgcgttcgaggctgtcggcggttgccttcgcggcctggtgagccgggaagaggtcgacgccatcgaacggaatttctgtccggtcgaaggggcctgcgcgggcatgttcaccgccaacacgatggccagcgcggcggaagcgctcggcatgtcattgcccggttcggcctcgccgcccgcgccggaccgccggcgcgacggtttcgcccgggcctccggggaggcagtcgtcaacctgctccgccgcggcatcaccgcccgggacatcatgacccgggaggcattcgagaacgcgatcgctgtcgtgatggccctgggcggctccaccaacgccgtgctccatctgctcgcgatcgcccgcgaggcgaacgtcgacctcgccatcgacgatttcaaccggatcggggaccgggtcccgcacttggcggatgtcaagccgttcggccggtacgtgatgagtgacgtcgaccgggtcggcggcgtgcccgtggtgatgaaagcgctgctggacgccgggctgctgcacggcgactgcctgacggtgaccggcaagacggtggcggagaacctcgcggacatcaccccgccggaccccgacggcaaggtgattcacgcgctcacccaaccgatccaccgcaccggcgggctggccattctccgcggttcgctcgccccggacggcgcggtggtgaagaccgccgggctggagtcgacgttcttcgaaggcaccgcccgggtgttcgacggcgaggaggcggccatgcgcgccgtgcccgagctgcgtccgggagatgtcgttgtcatccggtacgaggggccgaaaggcggcccagggatgcgggagatgctcgcggtcaccggcgccatcaagggcgcgggcctcggcaaggatgtgctcctcgtcaccgacggccggttctccggcggtaccacgggtttctgtgtcgctcacgttgctccggaggcggtggacgggggaccgatcgcgttcgtccgggacggtgaccgcatccggctggacgcgcaggcccgtaccctcgacctgctggtggacgccgatgagctggccaaacgacgggccgactggcaaccgccgccgccgcggtacaccaccggagtcgcggccaagtacgtcaagctggttggcagcgcctccgagggtgcgatctgtcggtga

SEQ ID NO: 40 - protein, 558 aa, Acidothermus cellulolyticus
MRAQPDLKPRSRDVTDGLERAAARGMLRAVGMTDADWEKPQIGVASSWNEITPCNLSLDRLAQAAKEGVHAAGGYPLEFATISVSDGISMGHEGMHFSLISREVIADSVETVFMAERFDGAVLLAGCDKSEPGMLMAAARLDLAAVFLYAGSTLPGKLGDRDINIVDAFEAVGGCLRGLVSREEVDAIERNFCPVEGACAGMFTANTMASAAEALGMSLPGSASPPAPDRRRDGFARASGEAVVNLLRRGITARDIMTREAFENAIAVVMALGGSTNAVLHLLAIAREANVDLAIDDFNRIGDRVPHLADVKPFGRYVMSDVDRVGGVPVVMKALLDAGLLHGDCLTVTGKTVAENLADITPPDPDGKVIHALTQPIHRTGGLAILRGSLAPDGAVVKTAGLESTFFEGTARVFDGEEAAMRAVPELRPGDVVVIRYEGPKGGPGMREMLAVTGAIKGAGLGKDVLLVTDGRFSGGTTGFCVAHVAPEAVDGGPIAFVRDGDRIRLDAQARTLDLLVDADELAKRRADWQPPPPRYTTGVAAKYVKLVGSASEGAICR

SEQ ID NO: 41 - DNA, 1704 bp, Corynebacterium efficiens
atgaccaacgatcatgacatcgatatcaagccacgttcacgcgatgtgaccgacggcctggaacgcaccgccgcccggggcatgctccgggcagtcggcatgggcgacgacgactgggagaaaccccagatcggtgtggccagctcctggaatgaaatcaccccctgtaatctcacgctgaagaagcttgctggatttgccaaggagggtgtccacgaggcggggggttaccccctggagttcgggaccatctccgtctccgacggtatctccatgggccacgagggcatgcactattccctggtatcccgcgaggtcatcaccgactccgtggaaaccgtcatgagtgccgagcgactggacggttctgttctactcgccggctgtgacaaatccattcccggcatgctcatggccgccgcccggttgaatctgtcctcggtgttcctctacaacggatccaccatgccgggcaccgcgaagatgtccgacggtacggagcgggaggtcaccctcatcgatgccttcgaggccgtcggagcctgtcgtgcgggaaccatgagccgggaggacgtggatgccattgaacgctccgtgtgccccggggagggtgcctgtggcggcatgtacacagccaacaccatggcctcggctgctgaggccatgggcatgtccctgcccggttccgccgctcccccggcgatccaccaggaccgcaccctctatgcccgccgttccggcgaggcggtggtggaactgctgcgcaggggaatccgtgcccgtgacatcatcacacgggaatcactgctcaatgccgtcgccgtggtcatggcgctgggtggctccaccaacgcggttctgcacctcatggccatcgcccacgaggccgaggtggatctcaccttggaggacttcaacgccgtcggcgacaaggtcccccaccttggtgacctcaaacccttcggccggtatgtgatgaacgacgtattcaagatcggcggcatccccgtggtgatgaaagcgcttctcgacgccggcctcatcaacggcgactgcctcaccatcaccggccggaccgttgcggagaacctccagggcatcaacccaccggatcccgacggccagatcctacgggccattgacaacccgatccacaagaccggtgggctgaccatcctgcacggttccctcgcaccgggtggtgccgtggtcaaaaccgctggtttcgacaccgaacgcttcgagggcaccgcccgtgtcttcaaccaggaagcacccgccatggatgcggtgctcaacggtgaactgaaggctggcgacgtggtgatcatccgctacgagggaccgaagggcggccccggcatgcgcgagatgctcgccatcaccggtgccatcaagggtgccggcatcggcaaggaggtgctgctcatcaccgacggtcgtttctccggtgggtccaccggcctgtgcatcgggcatgtggcccccgaggccgtcgacggcggacctatcgccctcgttgaagacggcgatcccatcctggtcgacatcagccaacgacgtatcgatctcctggtagacgaatccattctggaggagcgcaggaaaaccctgcagcatccggagaatccacgtctccacggcgtgctggggaagtacgccaagctggtgcagtcagcctcaatgggcgcggtctgcttctag

SEQ ID NO: 42 - protein, 567 aa, Corynebacterium efficiens
MTNDHDIDIKPRSRDVTDGLERTAARGMLRAVGMGDDDWEKPQIGVASSWNEITPCNLTLKKLAGFAKEGVHEAGGYPLEFGTISVSDGISMGHEGMHYSLVSREVITDSVETVMSAERLDGSVLLAGCDKSIPGMLMAAARLNLSSVFLYNGSTMPGTAKMSDGTEREVTLIDAFEAVGACRAGTMSREDVDAIERSVCPGEGACGGMYTANTMASAAEAMGMSLPGSAAPPAIHQDRTLYARRSGEAVVELLRRGIRARDIITRESLLNAVAVVMALGGSTNAVLHLMAIAHEAEVDLTLEDFNAVGDKVPHLGDLKPFGRYVMNDVFKIGGIPVVMKALLDAGLINGDCLTITGRTVAENLQGINPPDPDGQILRAIDNPIHKTGGLTILHGSLAPGGAVVKTAGFDTERFEGTARVFNQEAPAMDAVLNGELKAGDVVIIRYEGPKGGPGMREMLAITGAIKGAGIGKEVLLITDGRFSGGSTGLCIGHVAPEAVDGGPIALVEDGDPILVDISQRRIDLLVDESILEERRKTLQHPENPRLHGVLGKYAKLVQSASMGAVCF

SEQ ID NO: 43 - DNA, 1713 bp, Brevibacterium linens
atgagcattgatacgaactccaccaaaccggacatcaaaccacgttctcgcgacgtcaccgacggtctcgaagccaccgctgcgcgcggcatgctgcgtgccgtgggaatgggcgatgacgactgggtcaagccgcagatcgccatcgcgacctcgtggaacgagatcaccccgtgcaacatgtccctgcagcgcctcggtgcggccgccaaggaaggcgtgcacgaatcgggcggattccccctggaattcggcaccatctccgtctccgacggcatctccatgggccacgagggcatgcactactcgctggtctcgcgcgaggtcatcaccgactccgttgagaccgtgatgagcgccgaacgactcgacggatcggtcctcatggccggctgcgacaagtcgatcccgggcatgctcatggcatccgcccgcctcggcctctccagcgtattcctctacaacggctcgatcatgccgggtaccgcgaagatggaggacggcaccgagaaggaagtcaccctcatcgacgccttcgaagcagtcggcgcctgccgtgccggaaccatcagccaaaaagacgtcgactccatcgagcgcgccgtctgcccgggtgaaggcgcctgtggtggcatgtacaccgcgaatacgatggcctcggccgccgaggccatgggcatgtccctgccaggctcggccgcacctcctgccatccaccgcgaccgcacgatgttcgcgcgcaaatccggtgatgctgtcgtcaacctgctgcgtcagggaatcacgacgaaggacatcatcacccgcgaatcgctgcacaacgcgatcgccgtggtcatggccttcggcggatcgaccaacgcggttctccacctcctggccatcgcccacgaggccggagtcgaactcgccctcgatgacttcaaccgcatcggcgacaaggtcccgcacctgggcaacgtcaaacccttcggccagtacgtgatgaacgatgtgttcaagatcggcggcgtgccggtgatcatgaaggctctgctcgacaacggaatgctcaacggcgactgcatgaccgtgacgggaaagaccgtggcggagaacctcgagacgatcaacccgccggaccccgacggcaagatcctgcgcgcgctcaacaacccgattcacgccaccggcggcctcaccgtgctcaagggctcgttggctcccgaaggtgcagtcgtgaagtccgccggcttcgatgccgacgtcttcgaaggcaccgctcgcgtgttcaaccaggagaagccggccatggatgccgtcctcaacggtgagctgaagaagggcgatgtcgtcgtcatccgctacgaaggacccaagggcggacccggtatgcgcgagatgctcgccatcaccggtgcgatcaagggcgcgggaatcggcaaggacgtcctgctcatcaccgacggacgcttctccggcggatcgacgggactgtgcatcggtcacgtggcgcccgaggccgtcgacggcggaccgatcgcactcgtcgaggacggcgacaagatcaccgtcgacatcgcggcacggtccatcgacctgcatgttgacgagtcggtgctcgaagagcgtcgcaagacctggacgattcccgagaaccaccgcctcaccggtgtgctcggaaagtacgcgaagctcgtgcagtcggcctccaccggtgccgtctgcttctga

SEQ ID NO: 44 - protein, 570 aa, Brevibacterium linens
MSIDTNSTKPDIKPRSRDVTDGLEATAARGMLRAVGMGDDDWVKPQIAIATSWNEITPCNMSLQRLGAAAKEGVHESGGFPLEFGTISVSDGISMGHEGMHYSLVSREVITDSVETVMSAERLDGSVLMAGCDKSIPGMLMASARLGLSSVFLYNGSIMPGTAKMEDGTEKEVTLIDAFEAVGACRAGTISQKDVDSIERAVCPGEGACGGMYTANTMASAAEAMGMSLPGSAAPPAIHRDRTMFARKSGDAVVNLLRQGITTKDIITRESLHNAIAVVMAFGGSTNAVLHLLAIAHEAGVELALDDFNRIGDKVPHLGNVKPFGQYVMNDVFKIGGVPVIMKALLDNGMLNGDCMTVTGKTVAENLETINPPDPDGKILRALNNPIHATGGLTVLKGSLAPEGAVVKSAGFDADVFEGTARVFNQEKPAMDAVLNGELKKGDVVVIRYEGPKGGPGMREMLAITGAIKGAGIGKDVLLITDGRFSGGSTGLCIGHVAPEAVDGGPIALVEDGDKITVDIAARSIDLHVDESVLEERRKTWTIPENHRLTGVLGKYAKLVQSASTGAVCF

SEQ ID NO: 45 - DNA, 1710 bp, Tropheryma whipplei
gtgtttatgtcgagcgatgcaaatgcctgtgaaatagatataaagccgagaagccgagtcgtaacccatgggatcgaggcgacaacatcgcgtggtatgctgcgcgccgttggaatgggtgatgctgattgggaaaaaccacagattggcattgcatccagttggaataacataactccgtgcaatttgtcacttgacagacttgcgcagggtgcaagggaaggtgttcacgcagccggtgggtatccgctgcagttttgcactatatcggtttccgacggaatctctatgggtcatgagggaatgcatttttctcttgtttctcgcgaagttattaccgacagcgtggaaaccgttctgatggcagaggcactggatggtgttgttcttcttgctggctgtgataaatccctcccgggtatgcttatggcagctgcaaggcttgatgtgtctgcagtatttctatatgccggcagtattgcccccggttatgtcacactcaagtgtggcgagtcaaaagaagttacaataattgattcattcgaagccgttggtgcctataaggcagggcttattgatcaggatgatcttggccggattgaaagggccatatgccccggggagggcgcatgtggcggcatgtatacggcaaacacaatggcatctgttgcagaagcgcttggtatgagtcttttgggttcggcaagtccaccctcggcagatcgtcgtcgtgatgtttatgcacataagtcgggcgaggcggttgttgagctcctgaagcggggtataaccgcaagagatattttgacaaaagaggcatttgaaaatgcgatagcagttgttatggcccttggcggatctacaaacgccgttttgcatttacttgcgatagctcatgaggcccatgtgccactgacgatagacgattttaacaaaatcgggaatagggttcctcatattgcagacctcaagccttttgggcgctatgtaatgaatgatgtagatcgcgtgggaggtattccagttgttataaatgcattgatgcgggaaggttttatacacggtgatgtaattaccgtttcaggcagaacaatggccgaggagatatctgatatcaatccgggccttcccgacggaaaggttatacactctttttcctcacctctgcacccaacaggcggtataaaggtattaaaaggtacgcttgcaccggatggggccgttgcaaaaacagctggtttcgatactgtggtttttcaaggccccgcaatggtgtttgatcgcgagcgcgcggctatggatgctctcagtgctgggaatataaaaaaggggagcgttattgttattcgctatgaaggcccaaaagggggtccgggtatgcgagagatgctggctattaccgcggcaataaagggaagtggccttggtaaagatgttttattgttgacagacggcaggttctcgggcggtacaaccggtctgtgtatagggcatattgcgccagaggcggttgatcttgggccgattgcgtttgtgcaagatggcgatataatccgcgttgatattgagaaatcgagtattgatgttctggttgatgaaaagcaattgcgcgccaggcacttgactccacccccacccaggtatacaagcggtgttctttcaaaatattcaaaactcgtcaaatctgcttctttgggtgcaataacttag

SEQ ID NO: 46 - protein, 569 aa, Tropheryma whipplei
MFMSSDANACEIDIKPRSRVVTHGIEATTSRGMLRAVGMGDADWEKPQIGIASSWNNITPCNLSLDRLAQGAREGVHAAGGYPLQFCTISVSDGISMGHEGMHFSLVSREVITDSVETVLMAEALDGVVLLAGCDKSLPGMLMAAARLDVSAVFLYAGSIAPGYVTLKCGESKEVTIIDSFEAVGAYKAGLIDQDDLGRIERAICPGEGACGGMYTANTMASVAEALGMSLLGSASPPSADRRRDVYAHKSGEAVVELLKRGITARDILTKEAFENAIAVVMALGGSTNAVLHLLAIAHEAHVPLTIDDFNKIGNRVPHIADLKPFGRYVMNDVDRVGGIPVVINALMREGFIHGDVITVSGRTMAEEISDINPGLPDGKVIHSFSSPLHPTGGIKVLKGTLAPDGAVAKTAGFDTVVFQGPAMVFDRERAAMDALSAGNIKKGSVIVIRYEGPKGGPGMREMLAITAAIKGSGLGKDVLLLTDGRFSGGTTGLCIGHIAPEAVDLGPIAFVQDGDIIRVDIEKSSIDVLVDEKQLRARHLTPPPPRYTSGVLSKYSKLVKSASLGAIT

SEQ ID NO: 47 - DNA, 1731 bp, Methylobacterium extorquens
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaagcccaggccgtgaagaagggtgtcgccgccgccaagggcactccgcgcgagttctgcaccatcaccgtcaccgacggcatcgccatgggccatggcggtatgcgcgcctcgctgccttcccgcgaggtcatcgccgattcggtcgagctgacgatccgcggccattcctacgacgccctcgtggggctggccggctgcgacaagtccctgcccggcatgatgatggccatggtgcgcctcaacgtgccctcgatcttcatctatggcggctcgatcctgccgggctcgttccgcggccggccggttacggtgcaggatctgttcgaggcggtcggcaaggtcgccgtcggcgacatgagcctcgacgacctcgacgagctggagcgggttgcctgcccctcggccggcgcctgcggcgcgcagttcaccgccaacaccatggccaccgtctccgaggcgatcggcctcgcgctgccctactcggccggcgcgcctgccccttacgagatccgcgaccaattctgcgccgccgccggcgagaaggtgatggagctgatcgccaagaacatccgcccgcgcgacatcgtcacccgcaaggcgctggagaacgccgccgcgacggtcgcggcctcgggcggctcgaccaacgcggccctgcacctgccggcgatcgcgcatgaatgcggcatcgagttcaccctgttcgacgtcgccgagatcttccgcaagaccccctacatcgccgacttgaagcccggcgggcgctatgtggccaaggacatgttcgaggtcggcggcatcccgctgctgatgaagacgctgctcgaccacggctacctgcacggcgactgcctcaccgtcaccggccgcaccatcgccgagaacctcgccaaggtcgcctggaacccggatcaggacgtggtgcgcccggccgacaagcccatcaccgtcaccggcggcgtggtgggcctgcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttctccggcgcgacccgcggcttctgcgtcggccatgtcggccccgaggctgccatcggcgggccgatcggcctgctgcgcgacggcgacatcatcaccctcgatgcgatcaagggcacgctcgacgtggcgctctccgacgaggaactggcccagcgtcgcagcgaatggacgccgcggggcaatgccgcgacctccggctacctctggaaatacgcgcagtccgtcgggcctgcagtgaacggggccgtgacgcatccgggcggcgcgggggagacgaacgtctatgccgacatctag

SEQ ID NO: 48 - protein, 576 aa, Methylobacterium extorquens
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWTPRGNAATSGYLWKYAQSVGPAVNGAVTHPGGAGETNVYADI

SEQ ID NO: 49 - DNA, 1734 bp, Methylobacterium nodulans
atggacgcgcgtcacaccatcgacaagtcgaagctgccgagccgctatgtcaccgaggggccggcccgggcgccgcatcgctcgtatctctatgcgatggggctgacgcgggagcagatccaccagccgctggtgggcgtcgcctcctgctggaacgaggccgccccctgcaacatcgcgctcatgcgccaggcgcaggcggtgaagaagggcgtcgccgccgcggccggtaccccgcgggaattctgcaccatcacggtcaccgacggcatcgccatgggccaccggggcatgcgcgcctcgctgccctcccgggaggtcatcgccgattccgtcgagctcaccatgcggggccacgcctacgacgccctggtggggctcgcgggctgcgacaagtccctgcccggcatgatgatggcgatggtgcgcctgaacgtgccgtcgatcttcatctatggcggctcgatcctgcccggctccttccgcgggcggccggtcacggtccaggacctgtttgaggcggtcggcaagcactccgtcggccagatgagcgacgaggatctggacgagctggagcaggtcgcctgcccgtcggccggcgcctgcggggcgcagttcaccgccaacacgatggcgaccgtctccgaggcgatcggcctcgcgctgccctattcggccggcgcgcccgctccctacgagatccgcgacaagttctgcgcggcggccggcgagatggtgatggatctcctcgccaagaacatccgcccgcgcgacatcatcacccgcaaggcgctggagaacgccgccacggtggtcgccgcctccggcggctcgaccaatgcggcgctgcacctgccggccatcgcccacgaggcgggcatcgtcttcgacctgttcgacgtcgccgagatcttccggcgcacgccctacatcgccgacctcaagccgggcgggcgctacgtcgccaaggacctgttcgaggccggcggcatcccgctcctgatgaagaccctgctggaccacggcttcctgcacggcgactgcatcaccgtgaccggccgcaccatcgccgagaacctcgccaaggtggcctggaacccggaccaggacgtcgtgcggccggccgacaccccgatcaccccgaccggtggcgtggtcggcctcaagggcaacctcgcccccgagggcgcgatcgtgaaggtcgccggcatgccggccgaccgccaagtattcgccggcccggcccgcgtcttcgacaacgaggaagcctgtttcgaggcggtgcagaaccgccagtacaaggagggcgacgtcctcgtcatccgctacgagggcccgaagggcggccccggcatgcgcgagatgctggcgaccaccgccgccctctacggccagggcatgggcgacaaggtcgcgctcatcacggacggccgcttctcgggcgcgacccgcggcttctgcgtcggccatgtcgggcccgaggccgcaatcggcggcccgatcggccttctcaaggacggggacatcatccggctcgacgcgatccagggcatcctctcggtcgatctctccgacgaggaactggccgagcgccgcaaggcctggaccccgcgcgcgaacgaggcgacctccggctatctctggaaatacgcgcagaccgtcggcccggcggtgaccggcgccgtgacgcatccgggcggagcccaggagacgctcacctatgcggacatctga

SEQ ID NO: 50 - protein, 577 aa, Methylobacterium nodulans
MDARHTIDKSKLPSRYVTEGPARAPHRSYLYAMGLTREQIHQPLVGVASCWNEAAPCNIALMRQAQAVKKGVAAAAGTPREFCTITVTDGIAMGHRGMRASLPSREVIADSVELTMRGHAYDALVGLAGCDKSLPGMMMAMVRLNVPSIFIYGGSILPGSFRGRPVTVQDLFEAVGKHSVGQMSDEDLDELEQVACPSAGACGAQFTANTMATVSEAIGLALPYSAGAPAPYEIRDKFCAAAGEMVMDLLAKNIRPRDIITRKALENAATVVAASGGSTNAALHLPAIAHEAGIVFDLFDVAEIFRRTPYIADLKPGGRYVAKDLFEAGGIPLLMKTLLDHGFLHGDCITVTGRTIAENLAKVAWNPDQDVVRPADTPITPTGGVVGLKGNLAPEGAIVKVAGMPADRQVFAGPARVFDNEEACFEAVQNRQYKEGDVLVIRYEGPKGGPGMREMLATTAALYGQGMGDKVALITDGRFSGATRGFCVGHVGPEAAIGGPIGLLKDGDIIRLDAIQGILSVDLSDEELAERRKAWTPRANEATSGYLWKYAQTVGPAVTGAVTHPGGAQETLTYADI

SEQ ID NO: 51 - DNA, 1725 bp, Rhodopseudomonas palustris
atggacgcgaaggcgacgctcaagtcgaagctccccagccggcacgtgaccgaagggccggcgcgcgcgccccatcgctcttacctctacgccatgggcctcaccaccgagcagatccaccagccgttcgtcggggtggcgtcgtgctggaacgaggccgcgccctgcaacatttcgctgatgcggcaggctcaggcggtcaagaagggcgtcgcctccgccggcggcaccccgcgcgaattctgcaccatcaccgtgactgacggcatcgccatgggccacgagggcatgcgctcgtcgctgccgtcgcgcgaggtgatcgccgactccgtcgagctgacaatccgcggccactcctatgacgcgctggtcgggctggccggctgcgacaagtctctgcccgggatgatgatggcgatggtccggctcaacgtgccgtcgatcttcatctatggcggctcgatcctgccgggcaccttccggggccagcaggtcaccgttcaggacatgttcgaggcggtcggcaagcactcggtcggcgagatgtcggacgacgacctcgacgaaatcgagcgggtcgcctgtccgtcggccggcgcctgcggcgcgcagttcaccgccaacaccatggcgaccgtgtccgaggcgatcggcctagcgctgccgtattcggccggcgcacctgctccttacgaaatccgcgatgcgttctgcacggcggccggcgagaaggtgatggagctgatcgccgccaacatccggccgcgcgacatcgtcacccgcaaggcgctggagaatgcggccgcggtggtagcagcgtccggcggctcgaccaatgctgcgctgcacctaccagcgatcgcgcatgaatgtggtatcaagttcgatctgtttgatgtcgccgaaatcttcaaaaagacaccatatatcgcggatttgaagccaggcggccgttatgtcgccaaagacatgtatgaagttggcggcataccgctcctgatgaagaccctgctcgatcatggcttcctccacggcgactgcctgaccgtcacgggacggacgatcgccgagaatctgaaagccgtgaagtggaatccgcatcaggacgtggtgcggcaggcgaaccatccgatcaccgtgactgggggcgtcgtcgggctgaagggaaacctcgcaccagaaggtgcgatcgtgaaggtcgcgggaatgtcgaacctgaagttttccgggcctgcccgctgcttcgatcgcgaggaagacgcgttcgaggcggtgcagaagcggacctacaaggaaggcgaggtcctcgtgatccgctacgaggggccgcggggcggccccggaatgcgggaaatgctcgccaccactgcggcgctgaccggccagggcatgggcggcaagatcgcgctgatcaccgacggccggttctccggcgccacccgcggcttctgcatcggccatgtcggcccggaagcggcgctgggtggtccgatcgcgctgctgcgcgacggtgacatcatcgtcatcgacgccgaggccggaacgcttgacgtaaatttgaccgacgacgaactggccgcgcgcaagtccgaatgggcgcatcgcgcgacaaaccacacgtcgggtgcgctttggaaatatgcccagcaggtcgggcccgcagtcagcggcgctgtgactcatccgggcggggcggccgagaagcagtgctatgcggatgtttga

SEQ ID NO: 52 - protein, 574 aa, Rhodopseudomonas palustris
MDAKATLKSKLPSRHVTEGPARAPHRSYLYAMGLTTEQIHQPFVGVASCWNEAAPCNISLMRQAQAVKKGVASAGGTPREFCTITVTDGIAMGHEGMRSSLPSREVIADSVELTIRGHSYDALVGLAGCDKSLPGMMMAMVRLNVPSIFIYGGSILPGTFRGQQVTVQDMFEAVGKHSVGEMSDDDLDEIERVACPSAGACGAQFTANTMATVSEAIGLALPYSAGAPAPYEIRDAFCTAAGEKVMELIAANIRPRDIVTRKALENAAAVVAASGGSTNAALHLPAIAHECGIKFDLFDVAEIFKKTPYIADLKPGGRYVAKDMYEVGGIPLLMKTLLDHGFLHGDCLTVTGRTIAENLKAVKWNPHQDVVRQANHPITVTGGVVGLKGNLAPEGAIVKVAGMSNLKFSGPARCFDREEDAFEAVQKRTYKEGEVLVIRYEGPRGGPGMREMLATTAALTGQGMGGKIALITDGRFSGATRGFCIGHVGPEAALGGPIALLRDGDIIVIDAEAGTLDVNLTDDELAARKSEWAHRATNHTSGALWKYAQQVGPAVSGAVTHPGGAAEKQCYADV

SEQ ID NO: 53 - DNA, 1725 bp, Rhodopseudomonas palustris
gtggacgccaactccaacatcaaggcgaggttgcccagccgtcacgtgacggaaggcccggagcgtgcgccgcaccgctcctacctctatgcgatggggttgaccacgcagcagatccaccagccgttcgtcggcgtggcatcgtgctggaatgaagccgcgccctgcaacatctcgctgatgcgccaggcccaggcggtgaagaagggcgtcgccgccgcgggtggtacgccacgcgaattctgcaccatcaccgtcaccgacggcatcgccatgggccatgacggcatgcgctcgtcgctgccgtcgcgcgaatgcatcgccgactcggtcgagctgaccatccgcggccactcctacgacgcgctggtcgggcttgccggctgcgacaagtcgctgcccggaatgatgatggcgatggtccggctcaacgtgccgtcgatcttcatctatggcggctcgatcctgcccggcaccttccgcggccagcaggtcaccgtgcaggacatgttcgaggcggtcggcaagcattcggtcggcgcgatgtcggacgccgacctcgacgaaatcgaacgggtggcgtgcccctcggccggcgcctgcggcgcccagttcaccgccaacaccatggcgacggtgtcggaggcgatcggcctggcgctgccttattcggccggagcacctgcgccctatgagatccgcgacgccttctgcatgaccgccggcgagcagatcatgacgctgatcgccaagaatatccggccgcgcgacatcgtcaccttgaaggcgctgcagaacgccgcggcggtggtggcggcctccggcggctcgaccaatgcggcgctgcacctgccggcgatcgcgcatgaatgcggcatcaaattcgacctgttcgacgtcgccgaaatcttcaaaaagacaccctatgtcgcggatttgaaacccggcggccgttatgtcgccaaagacatgtacgaagttggtggcataccgcttctgatgaaaacattgctcgatcatggctacctgcacggcgactgcctgacggtcaccggccggacgattgcggaaaatttggcaaccgtgaaatggaatcccgaccaggacgtggtgcgcgcagcggataacccgatcaccgtgaccggtggggtggtcgggctgcaaggcaacctcgcccccgagggggcgatcgtgaaggtcgccgggatgtccaacttgaaattctccggcccggcgcgctgcttcgatcgcgaagaggacgccttcgaggcggtgcagcacaagacctatcgcgaaggcgaagtgatcgtgatccgctacgaagggccgcgcggcggccccggcatgcgcgagatgctgtcgaccaccgcggcgctgaccgggcagggcatgggcggcaagatcgcgctgatcaccgacggccggttctccggcgccacccgcggcttctgcatcggccatgtcggaccggaagccgcgctcggcggcccgatcgcgctgttgcaggacggcgacatcatcgagatcgacgcggtggccggcacgcttaacgtaaaattgaccgaagccgaactctccgcgcgcaagaccaattggcagccgcgtgagaccaaccattcgtcaggcgcgttgtggaagtatgcccaacaggtcggccccgcgctcggtggcgcggtgacccatccgggtggttcgcacgagaaacagtgttatgcggatgtttaa

SEQ ID NO: 54 - protein, 574 aa, Rhodopseudomonas palustris
MDANSNIKARLPSRHVTEGPERAPHRSYLYAMGLTTQQIHQPFVGVASCWNEAAPCNISLMRQAQAVKKGVAAAGGTPREFCTITVTDGIAMGHDGMRSSLPSRECIADSVELTIRGHSYDALVGLAGCDKSLPGMMMAMVRLNVPSIFIYGGSILPGTFRGQQVTVQDMFEAVGKHSVGAMSDADLDEIERVACPSAGACGAQFTANTMATVSEAIGLALPYSAGAPAPYEIRDAFCMTAGEQIMTLIAKNIRPRDIVTLKALQNAAAVVAASGGSTNAALHLPAIAHECGIKFDLFDVAEIFKKTPYVADLKPGGRYVAKDMYEVGGIPLLMKTLLDHGYLHGDCLTVTGRTIAENLATVKWNPDQDVVRAADNPITVTGGVVGLQGNLAPEGAIVKVAGMSNLKFSGPARCFDREEDAFEAVQHKTYREGEVIVIRYEGPRGGPGMREMLSTTAALTGQGMGGKIALITDGRFSGATRGFCIGHVGPEAALGGPIALLQDGDIIEIDAVAGTLNVKLTEAELSARKTNWQPRETNHSSGALWKYAQQVGPALGGAVTHPGGSHEKQCYADV

SEQ ID NO: 55 - DNA, 1725 bp, Bradyrhizobium sp.
atggacgcgaagaccgacatcaagcgcaggctgcccagccgtcatgtgacggaagggccggagcgtgcgcctcatcggtcgtatctctacgcgatgggcctgaccacggcccaaatccatcagcccttcgtcggcgtcgcctcgtgctggaacgaggccgcgccctgcaacatcgcgctgatgcggcaggcgcaagccgtgaagaagggcgtggcccacgccggcggcacgccgcgcgaattctgcaccatcaccgtgaccgacggcatcgccatgggccatgacggcatgcgctcgtcgctgccgtcgcgcgaggcgattgccgattcggtcgagctgacgattcgcggtcatgcctacgacgcgctggttggcctcgccggctgcgataaatcgctgccgggcatgatgatggcgatggtccggctcaacgtgccgtcgatcttcatttatggaggctcgatcctgcccggcaatttccgcggccagcaggtcaccgtgcaggacatgttcgaggcggtcggcaagcattcggtcggcgcgatgtcggatgaggatctcgacgagctcgagcgcgtcgcctgtccgtcggccggtgcgtgcggtgctcagttcacggccaacacgatggcgaccgtctccgaggcgatcggcctggcgctgccgtactcggctggcgcgcccgcaccttacgagatccgcgattccttctgcatgaccgccggcgagaaggtcatggagctgatatcagccaacatccggccgcgcgacatcgtgacgcgagcagcactcgagaatgccgctgcggttgtggcggcctccggcggctcgaccaacgcggccctgcatctaccagcgattgcacacgaggccggcatcaagttcgacttattcgatgtcgccgaaatcttcaaaaagacaccttatatcgcggatttgaagccgggtggccgctatgtcgccaaagacatgttcgaggctggtggcattccgctcttgatgaagacgttgctcgaccatggctatttgaacggcgactgcctcacagtcaccggccggacgatcgccgaaaacctcaaaggcgtgaagtggaatccgcaccaggacgtggtgaggccggccgaccagccgatcactgcaaccggaggtgtcgttggtttgaaaggcaatctcgcgccagagggtgcgatcgtgaaagtcgcgggcatgtcgaacttgaaattcactgggccggcccgctgcttcgatcgggaagaggatgcctttgaagccgttcagaagcggtcctatcgcgagggcgaggtcatcgtcatccgctatgagggcccgcgcggcggtcccggcatgcgggaaatgctgcagaccacggcggcgctgacggggcagggcatgggcggcaagatcgcgctcatcaccgatggccggttctcgggcgcgacgcgcggcttctgcatcggccatatcgggccggaggcggcggtcggcggaccgatcgcgctggtcgaggatggcgacatcatcgagatcgacgccgaggcgggcatcctgaacgtcaagttgagcgatgccgaactgacacaacgcaagaccaagtggacgccgcgtgaaacgcatcacacgtcaggtgcactttggaaatatgcccagcaggtgggacccgccgtggcgggggccgtcacccacccaggtggtgcgcaagagaagtattgctatgcggacatctga

SEQ ID NO: 56 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSREAIADSVELTIRGHAYDALVGLAGCDKSLPGMMMAMVRLNVPSIFIYGGSILPGNFRGQQVTVQDMFEAVGKHSVGAMSDEDLDELERVACPSAGACGAQFTANTMATVSEAIGLALPYSAGAPAPYEIRDSFCMTAGEKVMELISANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRPADQPITATGGVVGLKGNLAPEGAIVKVAGMSNLKFTGPARCFDREEDAFEAVQKRSYREGEVIVIRYEGPRGGPGMREMLQTTAALTGQGMGGKIALITDGRFSGATRGFCIGHIGPEAAVGGPIALVEDGDIIEIDAEAGILNVKLSDAELTQRKTKWTPRETHHTSGALWKYAQQVGPAVAGAVTHPGGAQEKYCYADI

SEQ ID NO: 57 - DNA, 1725 bp, Bradyrhizobium japonicum
atgaacgcaaagaccaacatcaagcagaggctgccgagccgtcacgtgacggaaggccctgcgcgcgcgccccatcgctcctacttctacgccatgggtctgacgacggagcagatccaccagcccttcgtcggcgtcgcctcctgctggaacgaggccgcgccctgcaacatcgctttgatgcgccaggcgcaggcggtgaagaagggcgtcgcgcatgccggcggcacaccccgcgaattctgcaccatcaccgtgaccgacggcatcgccatgggccatgacggcatgcgctcctcgctgccgtcgcgcgaatgcatcgccgattccgtcgagctgaccgtccgcggccatgcctatgacgccctcgtcggccttgccggctgcgacaagtcgctgccgggcatgatgatggcgatggttcgcctcaacgtgccctcgatcttcatctatggcggctcgatcctgcccggcaacttccgcgggcagcaggtcaccgtgcaggacatgttcgaggccgtcggcaagcactcggtcggcgccatgtcggacgaggatctcgacgagatcgagcgcgtggcgtgcccctcggcgggtgcctgcggcgcgcagttcacggccaacaccatggcgaccgtctcggaagccatcggccttgcgctgccttactcggccggtgctccggcaccgtatgaaatccgcgacgccttctgcatgaccgcgggcgagaaggtgatggagctgatcgaccagaacatccggccgcgcgacatcgtcacccgcaaggcgctggagaatgcggccgccgtggtcgcggcctccggcggctcgaccaatgctgcgctgcacctgccggcgatcgcgcacgagtgcggcatcaagtttgacttattcgacgtcgccgaaatcttcaaaaagacaccatatgtcgcggatttgaagccgggcggccgttatgtcgccaaagacatgtttgaagtaggtggcatcccgcttctgatgaagacgctgctcgacaacggatttctccacggcgactgcattacggtcaccggtcgaacgatcgccgaaaacctcaagagcgtgaagtggaatccgcaccaggatgtggtgcacccggcagacaagccgatcaccgtcaccggtggtgtggtgggtctgaagggcaatttggcgccagaaggtgcgatcgtgaaagtcgcgggaatgtccaacctgaggtttaccggtccggcacgctgcttcgaccgggaagaggacgccttcgaggccgtccagaaccgcacataccgcgaaggcgaagtcatcgtgatccgctacgagggccccaagggcggccccggcatgcgggaaatgctccagaccaccgcggcgctgaccgggcagggcatgggcggcaagatcgcgctcatcactgacggccgcttctccggcgccacccgcggcttctgcatcggccatgtcgggccggaagccgccatcggcggcccgatcgggctgctcgaggatggcgacatcatcgagatcgacgcggtcgccggcacccttaacgtaaaattgagcgaccaggagcttgcccagcgcaagaccaaatggagcgctcgcgcgactaaccacacgacgggcgcgctctggaaatatgctcagcaggttggaccagcggtcgggggggcggtcacccatccgggcggtgcgcacgagaaacagtgctatgcggacatctag

SEQ ID NO: 58 - protein, 574 aa, Bradyrhizobium japonicum
MNAKTNIKQRLPSRHVTEGPARAPHRSYFYAMGLTTEQIHQPFVGVASCWNEAAPCNIALMRQAQAVKKGVAHAGGTPREFCTITVTDGIAMGHDGMRSSLPSRECIADSVELTVRGHAYDALVGLAGCDKSLPGMMMAMVRLNVPSIFIYGGSILPGNFRGQQVTVQDMFEAVGKHSVGAMSDEDLDEIERVACPSAGACGAQFTANTMATVSEAIGLALPYSAGAPAPYEIRDAFCMTAGEKVMELIDQNIRPRDIVTRKALENAAAVVAASGGSTNAALHLPAIAHECGIKFDLFDVAEIFKKTPYVADLKPGGRYVAKDMFEVGGIPLLMKTLLDNGFLHGDCITVTGRTIAENLKSVKWNPHQDVVHPADKPITVTGGVVGLKGNLAPEGAIVKVAGMSNLRFTGPARCFDREEDAFEAVQNRTYREGEVIVIRYEGPKGGPGMREMLQTTAALTGQGMGGKIALITDGRFSGATRGFCIGHVGPEAAIGGPIGLLEDGDIIEIDAVAGTLNVKLSDQELAQRKTKWSARATNHTTGALWKYAQQVGPAVGGAVTHPGGAHEKQCYADI

SEQ ID NO: 59 - DNA, 1725 bp, Fulvimarina pelagi
atggacgcacgcgtgatcgacaagacgaaacttccgagccgtcatgtgacggaaggaccgacccgcgcgccgcaccgctcgtatctctatgcgatgggtctctccaaggaagagatccatcagccactggtcggtgttgcctcctgctggaacgaggccgcaccctgcaatatctcgctgatgcgtcaggcgcaggtcgtaaaaaagggcgttgctgccgcacacggaacgccgcgcgaattctgcacgattaccgtcaccgacggtattgccatgggccatcagggcatgaagtcgtcgctggtctcgcgcgatctcatcgccgactcggtcgaactcaccatgcgaggccactcctacgacgcgcttgtcggtcttgccggctgcgacaagtcgctgccaggcatgatgatgtcgatggtacgcctcaacgttccctcggtcttcatctacggtggctcgattctgcccggcaccttcaagggccggcaggtgaccgtgcaggatattttcgaggcggttggccagcattccgtcggcgagatgtcggacgaggatctcgacctgatcgaacaggttgcctgcccctccgccggttcctgcggcgcccagttcacagcgaacaccatggcgacggtcgcagaggcgatcggccttgcgctgccatactcctgcggtgcgccggcgccttacgaaatccgcgaccgcttctgctacgcctcgggcgagatcgtgatggatcttctgcgccgtaacatccgtccgcgcgacatcgtcacccgcaagtcgctggagaatgcggcggccgtcgtcgcggccacgggcggctcgaccaatggcgcgctgcatctgccggcgatcgcccatgagtgtggcatcgagttcgatctcttcgacgtcgccgagatcttccgcaagacgccctacgtcgcggacctcaaaccgggtggcaaatacgtcgccaaggacatgttcgaggccggcggcattccgctcctgatgaagaccatgctggagcacggctatctccacggcgactgcatgacggtcaccggacgcacgatggccgagaacatggagaaggtcgcctggaacgcggatcaggatgtggttcgcccagccaacaatccgatcacgaagaccggcggtgttgtcggcctgaagggcaatctcgcttccgacggtgcgatcgtgaaggtcgcgggcatgaagaacctgaaattctcagggccagcgcgctgtttcgattcggaggaggattgtttcaaagcggtttcggctcgcgactataaggagggcgaggttctcgtcattcgctacgagggtccgaaaggtggccccggcatgcgcgagatgcttcagacgaccgctgcgatctacggccagggaatgggcgacaaggtcgccctcatcactgatggccgcttttccggcgccacccgcggcttctgcatcggccatgttggcccggaagcggcggtcggcggaccgatcggccttttgaaagacggcgacgtgattacgatcgacgcagtcgagggaacgctggacgttgcattgagcgaagatgaactcgccgagcgccgcaaggcttgggagccgcgcgaaaccgactatcagtcgggcgcgctctggaagtatgcccaggtggttggcacggcccgtctcggtgccgtcacccatcccggcggtgcagccgagaggcagtgctatgcggacatctaa

SEQ ID NO: 60 - protein, 574 aa, Fulvimarina pelagi
MDARVIDKTKLPSRHVTEGPTRAPHRSYLYAMGLSKEEIHQPLVGVASCWNEAAPCNISLMRQAQVVKKGVAAAHGTPREFCTITVTDGIAMGHQGMKSSLVSRDLIADSVELTMRGHSYDALVGLAGCDKSLPGMMMSMVRLNVPSVFIYGGSILPGTFKGRQVTVQDIFEAVGQHSVGEMSDEDLDLIEQVACPSAGSCGAQFTANTMATVAEAIGLALPYSCGAPAPYEIRDRFCYASGEIVMDLLRRNIRPRDIVTRKSLENAAAVVAATGGSTNGALHLPAIAHECGIEFDLFDVAEIFRKTPYVADLKPGGKYVAKDMFEAGGIPLLMKTMLEHGYLHGDCMTVTGRTMAENMEKVAWNADQDVVRPANNPITKTGGVVGLKGNLASDGAIVKVAGMKNLKFSGPARCFDSEEDCFKAVSARDYKEGEVLVIRYEGPKGGPGMREMLQTTAAIYGQGMGDKVALITDGRFSGATRGFCIGHVGPEAAVGGPIGLLKDGDVITIDAVEGTLDVALSEDELAERRKAWEPRETDYQSGALWKYAQVVGTARLGAVTHPGGAAERQCYADI

SEQ ID NO: 61 - DNA, 1815 bp, Aurantimonas sp.
ttgccgccacaaaacccgctcaccccagaggtgctgatcgggcgcggcgtcgaggcgggccatgaacagcgttgtgtacgagggggaccgatggacgcgcattcgatcgacaagaagaacctgcccagccggcatgtgaccgaggggccgtcgcgcgcgccgcaccgctcgtacctctacgccatgggtctcaccaaggaagagatccatcagccgctggtcggcgtcgcctcctgctggaacgaggccgcgccgtgcaacatctcgctgatgcgccaggcgcaggtcgtcaagaagggcgtcgcggcagcccgcggtacgccgcgcgagttctgcaccatcaccgtcaccgacggcatcgccatgggccatcagggcatgaaggcttcgctcgtctcgcgcgacctcatcgccgattcggtcgaactgaccatgcgcggccacgcctatgacgcgctggtgggtctggcaggttgcgacaagtcgcttccgggcatgatgatggcgatggttcgcctgaacgtgccgtcggtcttcatctatggcgggtcgatcctgccgggcaatttccgcggccagcaggtcaccgttcaggacatcttcgaggcggtcggcaagcattcggtcggcgagatgaacgacgccgatctcgacgagatcgagcaggtcgcctgtccgtcagccggttcctgcggcgcgcagttcaccgccaacaccatggcgaccgtcgccgaggccattggcctggcgctgccctattcctgcggtgcgccggcgccctacgagatccgcgacaagttctgctacgcctcgggcgagatcgtcatggaactcttggcccgcaacatccggccgcgcgacatcgtcacccgcaaggcgttggagaacgccgccgccgtcgtcgcggcgaccggcggatcgaccaatggcgccctgcacctgccggcgatcgcgcatgagtgcggcatcgagttcgacctgttcgacgtcgcggagatcttccgcaagacgccgtacatcgccaacctcaagccgggcggcaaatacgtcgccaaggacatgttcgaggccggcggcatcccgatgctgatgaagaccatgctggaccatggctatctgcacggcgactgcatgaccgtcaccggccgcaccattgccgagaacatggcgaaggtgacctggaacccgaaccaggacgtcatccatccggccaacacgccgatcacccagaccggcggcgtcgtcggcctgaagggtaacctcgcccaggacggcgccatcgtgaaggtcgcgggcatgaagaacctgcggttctccggcccggcgcgctgcttcgattcggaagaggaatgctacgaggccgtctccaagcgccagtacaaggaaggcgaggttctcgtcatccgctacgagggcccgcgcggcggacccggcatgcgcgagatgctgtcgaccacggcggcgctctacggccagggcatgggcgacaaggtcgcgctgatcaccgacggccggttctccggcgcgacccgcggcttctgcatcggccatgtcggtccggaagcggcgctcggcggtccgatcggcctgctgcgcgacggtgacatcatcaccatcgatgccgtcgccgggacactggacgtggacgtctcggatgacgacatgaagaagcgggccgaagactggaagccccgcgaaaccgactaccagtccggtgccatctggaaatacgcccagcaggtcggcacggcgcgcctcggcgcagtgacacatccgggcgcagcggcggaaaagcactgttatgcggacctctag

SEQ ID NO: 62 - protein, 604 aa, Aurantimonas sp.
MPPQNPLTPEVLIGRGVEAGHEQRCVRGGPMDAHSIDKKNLPSRHVTEGPSRAPHRSYLYAMGLTKEEIHQPLVGVASCWNEAAPCNISLMRQAQVVKKGVAAARGTPREFCTITVTDGIAMGHQGMKASLVSRDLIADSVELTMRGHAYDALVGLAGCDKSLPGMMMAMVRLNVPSVFIYGGSILPGNFRGQQVTVQDIFEAVGKHSVGEMNDADLDEIEQVACPSAGSCGAQFTANTMATVAEAIGLALPYSCGAPAPYEIRDKFCYASGEIVMELLARNIRPRDIVTRKALENAAAVVAATGGSTNGALHLPAIAHECGIEFDLFDVAEIFRKTPYIANLKPGGKYVAKDMFEAGGIPMLMKTMLDHGYLHGDCMTVTGRTIAENMAKVTWNPNQDVIHPANTPITQTGGVVGLKGNLAQDGAIVKVAGMKNLRFSGPARCFDSEEECYEAVSKRQYKEGEVLVIRYEGPRGGPGMREMLSTTAALYGQGMGDKVALITDGRFSGATRGFCIGHVGPEAALGGPIGLLRDGDIITIDAVAGTLDVDVSDDDMKKRAEDWKPRETDYQSGAIWKYAQQVGTARLGAVTHPGAAAEKHCYADL

SEQ ID NO: 63 - DNA, 1725 bp, Hoeflea phototrophica
atgagcgtcaaagcattcgacaagtccaagcttccaagccgctacacaacggtcggcccggcgcgggcgccgcacagatcgttcctgtatgctatggggctttcgagcgaggagattgctcagccgctcgttggcgtggcgtcgtgctggaatgaggccgcaccctgcaacatttcgctgatgcgccaggcgcaggtggtgaagaaaggcgtggcttcggcccacggcacaccgcgcgaattctgcaccatcacagtgactgatggcattgcgatgggtcaccagggcatgaaagcttccctggcgagccgcgatctgattgcagattcggtggaattgaccatgcgcggtcactgctacgatgcgatcgtgggtcttgccgggtgcgacaagtcattgccgggcatgatgatgtcgatggtgcgtctgaacgtgccctcgatcttcatctatggcggttctattttgccaggcagcttccgcggccgccagattaccattcaggacgtgttcgaggccgtggggcagcattcggttggcgatatgtcggatgaagacctgctcgaaatcgagcaggttgcctgtccgtcggcgggttcctgcggcgcgcagttcacagccaacacgatggcgactgttgccgaggcgatcggactggcgctgccctattcatgtggcgcgccggcgccttacgagatccgcgaccggttcgcttacgcggccggtgaaaaagtgatggaattgctggccaagcagatccgtccgcgcgacatcgtgacccgcaaggcgctcgaaaacgccgcggccgtcgtcgcggcttcgggcggttcgaccaacgcggcgctgcatctgccagcgattgcgcatgaatgcgggatcgagttcgatctgtttgacgtggctgagatcttcaagaagacgccctacattgccgacctcaagcccggcggcaaatatgtggccaaggacatgttcgaggctggtggcattccgctgttgatgaagaccatgcttgaacatggctatctgcacggcgattgcatgaccgtgacgggccggaccatcgccgagaacatggagaaggtctcctggaacccggagcaggatgtggtgcgcccggcggataagccgatcaccgcgaccggcggtgtggtgggcctcaagggcaatcttgcgaccgacggggcgatcgtgaaagttgccgggatggaacggctgaaattcaccggacccgcacggtgttttgattccgaggaagagtgcttcaatgcggtcacaaatcgcgactataacgaaggcgacgttcttgtgatccgctacgaggggcccaagggcggccccggtatgcgtgagatgctgtcgaccactgcggccatttatggacagggtatgggcgacaaggtggcattgatcacggatggccggttctccggtgcaacgcgcggcttctgcattggccatgtcggcccggaagcggcggaaggcgggccgatcgggctcctggaagatggcgacatcatcgagatcgatgctgttgatggtgttttgagcgtgcagctttccgatgcggaactggctgcgcgcagggaaaagtggacggcgcgcgaaaccgattatgcatcgggcgtgctgtggaaatatgcccagacggtgggggccgcgcgttacggcgccgttacccatccgggcggagcaaaagaaaagcagtgctatgcggatatctga

SEQ ID NO: 64 - protein, 574 aa, Hoeflea phototrophica
MSVKAFDKSKLPSRYTTVGPARAPHRSFLYAMGLSSEEIAQPLVGVASCWNEAAPCNISLMRQAQVVKKGVASAHGTPREFCTITVTDGIAMGHQGMKASLASRDLIADSVELTMRGHCYDAIVGLAGCDKSLPGMMMSMVRLNVPSIFIYGGSILPGSFRGRQITIQDVFEAVGQHSVGDMSDEDLLEIEQVACPSAGSCGAQFTANTMATVAEAIGLALPYSCGAPAPYEIRDRFAYAAGEKVMELLAKQIRPRDIVTRKALENAAAVVAASGGSTNAALHLPAIAHECGIEFDLFDVAEIFKKTPYIADLKPGGKYVAKDMFEAGGIPLLMKTMLEHGYLHGDCMTVTGRTIAENMEKVSWNPEQDVVRPADKPITATGGVVGLKGNLATDGAIVKVAGMERLKFTGPARCFDSEEECFNAVTNRDYNEGDVLVIRYEGPKGGPGMREMLSTTAAIYGQGMGDKVALITDGRFSGATRGFCIGHVGPEAAEGGPIGLLEDGDIIEIDAVDGVLSVQLSDAELAARREKWTARETDYASGVLWKYAQTVGAARYGAVTHPGGAKEKQCYADI

SEQ ID NO: 65 - DNA, 1761 bp, Mesorhizobium loti
atgcggcaggccgcaccgcccgcggcaaggatgagaatggacgccaaggtcatttcaaaggctaagctccctagccgccatgtgactgtcggtccggcgcgtgcgccgcaccggtcctatctctatgccatggggctttccgccgccgagatcgcgcagccgctggtcggcgtcgcctcctgctggaacgaagccgcgccctgcaacatctcgctgatgcgccaggcgcaggtggtcaagaagggtgtcgccgccgccaacggcacaccgcgcgaattctgcaccatcaccgtcaccgacggcatcgccatgggccaccagggcatgaagtcgtcgctggtgtcgcgcgaggtcatcgccgattcggtcgagctcacgatgcgtggccattgctacgatgcgctggtcggcctcgccggctgcgacaagtcgctgcccggcatgatgatggccatggtgcggctcaacgtgccgtcgatcttcatctatggcggttcgatcctgcccggcagctatcgcggccgtcagattaccgtgcaggacgtgttcgaggcggtcggccagcactccgtcggcacgatcggcgacgccgagctgctcgagatcgagcaggcggcctgtccgtcggccggctcctgcggcgcccagttcaccgccaacaccatggcaaccgtcgccgaggcgatcggtctggcgctgccctattcctgcggcgcgccggcgccttacgaaatgcgcgaccgcttcaatttcgcctccggcgaaaagatcatggagctgatcgccaaaaacatccggccgcgcgacatcatcacgctgaaggcgctggagaacgcggcgaccgtggtttccgccaccggcggttcgaccaatgcggcgctgcatctgccggcgatcgcgcatgaggcgggcatcaaattcgatctcttcgatgtcgcaaggattttcgagaagacgccctacatcgccgacctcaagcctggcggcaaatatgtcgcaaaggacatgttcgaggccggcggcattccgctgttgatgaagacgctgctcgaccacggctatctgcatggcgattgcctgacggtgactggccgcactttggccgaaaacatggagcacgttgcctggaatgaacaccaggatgtggtccgcccggccaacagaccaattacccaaaccggcggtgtcgtgggcttgaagggaaaccttgcccccgaaggcgcgatcgtgaaagtcgcgggcatgacggagttgaaattctccggcccggcgcgctgcttcgattcggaagaggaatgtttcgaggcggtgacgcaacgcaactacagggaaggcgaggttctcgtcattcgctacgaagggccgcgcggtggtcccggcatgcgcgagatgctgtcgacgacggcagcgctctacggccagggcatgggcggcaaggtggcgctgatcaccgacggccgcttctcgggcgcgacgcgcggcttctgcatcggccatgtcgggccggaagcggcggtgggcggcccgatcggcctcatccgggatggcgacgtgatttcgatcgacgccgtgaacggcacgatcgaagtggcgctgtcggatagcgaactggcggcgcgggccaagacatggaaggcgcgcacgaccgactatcagtcgggcgcgatatggaaatacgcacagacggtcgggtctgccagggatggcgcggtcacccatccgggtggtgcgaaagaaacacactgctatgcggatatctga

SEQ ID NO: 66 - protein, 586 aa, Mesorhizobium loti
MRQAAPPAARMRMDAKVISKAKLPSRHVTVGPARAPHRSYLYAMGLSAAEIAQPLVGVASCWNEAAPCNISLMRQAQVVKKGVAAANGTPREFCTITVTDGIAMGHQGMKSSLVSREVIADSVELTMRGHCYDALVGLAGCDKSLPGMMMAMVRLNVPSIFIYGGSILPGSYRGRQITVQDVFEAVGQHSVGTIGDAELLEIEQAACPSAGSCGAQFTANTMATVAEAIGLALPYSCGAPAPYEMRDRFNFASGEKIMELIAKNIRPRDIITLKALENAATVVSATGGSTNAALHLPAIAHEAGIKFDLFDVARIFEKTPYIADLKPGGKYVAKDMFEAGGIPLLMKTLLDHGYLHGDCLTVTGRTLAENMEHVAWNEHQDVVRPANRPITQTGGVVGLKGNLAPEGAIVKVAGMTELKFSGPARCFDSEEECFEAVTQRNYREGEVLVIRYEGPRGGPGMREMLSTTAALYGQGMGGKVALITDGRFSGATRGFCIGHVGPEAAVGGPIGLIRDGDVISIDAVNGTIEVALSDSELAARAKTWKARTTDYQSGAIWKYAQTVGSARDGAVTHPGGAKETHCYADI

SEQ ID NO: 67 - DNA, 1728 bp, Mesorhizobium sp.
atgatggacgctcgtgcgatatcgaaggaaaagctgcccagccgctacgttaccgtagggccggcgcgggcgccgcacaggtcttatctttacgcgatggggctctcggcggaagagatcgctcagccgctggtcggcgtggcgacgtgctggaacgaggctgcgccctgcaacatctcgctgatgcgccaggcgcaagtggtgaaaaagggcgtcgcggcagccaaaggcacgccccgcgagttcacaacgattaccgttactgatggcatcgccatgggccaccagggcatgaaggcgtcgctggcctcgcgcgaggtaatcgcggattctgtggaactcaccatgcgcggccattgctatgacgcgcttgtcggccttgcgggttgtgacaaatccctgccggggatgatgatggccatggtgcgcctcaatgtgccgtcggtcttcatctatggcggttcgatcctgcctggcacctggcgcgggcggcagatcaccgttcaagacgttttcgaggcggtcggccagcattcggttggctccatttccgacgacgagctgatggaaatcgagcaagccgcttgtccctcggccggttcctgcggcgctcaattcacggccaacaccatggcgaccgttgccgaggcgattgggctggcgcttccttattcctgcggtgcgcctgcgccttacgagatgcgcgatcgcttcaactatgccgccggcgagaaggtgatggaactggtggccaagcagatacggccgcgtgacatcgtgacccggaaggcgcttgaaaacgccgcggccgtggttgccgcgtcggggggctccaccaatgcggcattgcatttgccggccatcgctcatgaagccggaattgaattcgaccttttcgacgtcgcggaagtgttcaagagaacaccctatgtcgccgatttgaagccgggcggcaaatatgtcgccaaggacatgttcgaggcgggcggcattccgctgctcatgaagaccttgctcgaccatggctatctgcatggcgactgcatgaccgtcaccggccgcacgcttgcggagaacatggaacgcgtcgagtggaacgatgcgcaggacgtggtttatccggctgacaagccgctgagcccgacgggcggcgtcgtgggccttaaaggcaatctcgcgccggatggggcaatcgtgaaggttgcaggcatgaagaacctgcgcttctccggccccgcgcgctgcttcgattcggaagaggaatgcttcgccgcggtttccgagcgccgctataaggaaggcgaggtgctggtgatccgctacgaaggtccgaaaggcgggccgggcatgcgtgaaatgctcgccaccaccgcggccctttacgggcagggcatgggcgacaaggtggcgctgatcacggacgggcggttttcaggcgcgacccgcggcttctgtatcggtcatgtcgggccggaagcagcagtgggcgggccgatagggcttctcaatgacggcgacatcataaccatcgatgcggtggcaggcacgatcgacgtggcgctcggcgaagcggaactggccgaacgccgcgctgcctggaggccgcgcgaaagcgaatatcggtccggcgcgatctggaaatacgcgcagggcgtgggcccggcgcggtatggcgcggtgacgcatcccggcgcccagaaagaaacgcactgctatgcggatatctga

SEQ ID NO: 68 - protein, 575 aa, Mesorhizobium sp.
MMDARAISKEKLPSRYVTVGPARAPHRSYLYAMGLSAEEIAQPLVGVATCWNEAAPCNISLMRQAQVVKKGVAAAKGTPREFTTITVTDGIAMGHQGMKASLASREVIADSVELTMRGHCYDALVGLAGCDKSLPGMMMAMVRLNVPSVFIYGGSILPGTWRGRQITVQDVFEAVGQHSVGSISDDELMEIEQAACPSAGSCGAQFTANTMATVAEAIGLALPYSCGAPAPYEMRDRFNYAAGEKVMELVAKQIRPRDIVTRKALENAAAVVAASGGSTNAALHLPAIAHEAGIEFDLFDVAEVFKRTPYVADLKPGGKYVAKDMFEAGGIPLLMKTLLDHGYLHGDCMTVTGRTLAENMERVEWNDAQDVVYPADKPLSPTGGVVGLKGNLAPDGAIVKVAGMKNLRFSGPARCFDSEEECFAAVSERRYKEGEVLVIRYEGPKGGPGMREMLATTAALYGQGMGDKVALITDGRFSGATRGFCIGHVGPEAAVGGPIGLLNDGDIITIDAVAGTIDVALGEAELAERRAAWRPRESEYRSGAIWKYAQGVGPARYGAVTHPGAQKETHCYADI

SEQ ID NO: 69 - DNA, 1731 bp, Parvibaculum lavamentivorans
atggacgccaagacattcgacaaatcgaaactgccgagccgccacgtcacggtcgggccggagcgcgcgccgcaccggtcctactactatgcgatgggcctcaccgaggaagagatcaatcagcccttcgtcggcgtggcgacctgctggaacgaggcggctccctgcaacatcgcgttgatgcgtcaggcgcagtcggtgaagaagggtgtcaaggccgccgccggcacgccccgcgaattctgcaccatcacggtgacggacggcatcgccatgggccaccagggcatgaaatcctcgctcgccagccgcgacgtgatcgcggattcggtcgagctcaccatgcgcggtcattgctacgacgcgctggtcggccttgccggctgcgacaagtcgctgccgggcatgatgatgtcgatggttcgtctcaacgtcccctccgtcttcatgtatggcggctcgatcctgccgggccatttcaagggcaaggacgtcaccgtggtcgacgtcttcgaggcggtcggccagcactcggcgggcaacatggaagacgaagagctgcatgcgctcgaatgcgtcgcctgtccctccgccggcgcctgcggcggccagttcacggccaacaccatggcctgcgtttcggaagccatgggcctcgcgctgccgggttcggcgggcgcgcctgcgccttatgagagccgcgacgaatatgcggaagcctcgggccgcgccgtcatgcacctcctcgccaacaacatccggccgcgcgacatcgtcacgcgcaaggcgctcgagaatgccgccgtcatcgtcgcggcgacgggcggttcgaccaatggcgggcttcatctcccggccatcgcgcatgaagcgggcatcgatttcgacctgatggaagtcgccgaaatcttcaagaagacgccctacatcaccgacctgaagcccggcggcaattacgtcgcgaaggatcttcacgaggcgggcggcgtttcgatggtcctcaaggtgctgctcgatggcggctatctccacggcgattgcctcaccgtcaccggccagtcgctcgcagacaacctcaaggacgtgaagttcaacccggaccagaaggtcgtctatccgctgtccaatccgctctcgcccaccggcggcgttgtcgggttgcagggctcgctcgcgccggatggcgccatcgtcaaggtcgcgggcatggagaaggatcatctccgtttctccggtccggcgcgttgcttcgacagcgaagaggaatgcttcgaggcggtcgacaaacgtcagtacaaggaaggtgaggttctcgtcatccgctacgagggaccgaagggtggccccggcatgcgcgaaatgctctccaccaccgccgcgctttacggccagggcatgggcgacaaggtcgcgctcatcaccgatggccgcttctccggcggcacgcgcggtttctgcatcggccatgtcggcccggaagccgccgtcggcggccccatcgcgctgatcgaggatggcgacatcatcaccatcgacgcggagaacggcaccatcgatctcgaagtcgacgaagccgtgctcgaaaagcgccgcgcgaactggaagccccgggagaccatgtacgcctccggcgcgctgtggaaatacgcgcagctcgtcggcaccgcccgcaagggcgccgtcacccatccgggcggcaaggcggagaaacatgtctatgcggatatctga

SEQ ID NO: 70 - protein, 576 aa, Parvibaculum lavamentivorans
MDAKTFDKSKLPSRHVTVGPERAPHRSYYYAMGLTEEEINQPFVGVATCWNEAAPCNIALMRQAQSVKKGVKAAAGTPREFCTITVTDGIAMGHQGMKSSLASRDVIADSVELTMRGHCYDALVGLAGCDKSLPGMMMSMVRLNVPSVFMYGGSILPGHFKGKDVTVVDVFEAVGQHSAGNMEDEELHALECVACPSAGACGGQFTANTMACVSEAMGLALPGSAGAPAPYESRDEYAEASGRAVMHLLANNIRPRDIVTRKALENAAVIVAATGGSTNGGLHLPAIAHEAGIDFDLMEVAEIFKKTPYITDLKPGGNYVAKDLHEAGGVSMVLKVLLDGGYLHGDCLTVTGQSLADNLKDVKFNPDQKVVYPLSNPLSPTGGVVGLQGSLAPDGAIVKVAGMEKDHLRFSGPARCFDSEEECFEAVDKRQYKEGEVLVIRYEGPKGGPGMREMLSTTAALYGQGMGDKVALITDGRFSGGTRGFCIGHVGPEAAVGGPIALIEDGDIITIDAENGTIDLEVDEAVLEKRRANWKPRETMYASGALWKYAQLVGTARKGAVTHPGGKAEKHVYADI

SEQ ID NO: 71 - DNA, 1734 bp, Loktanella vestfoldensis
atgcccagcaaccgtgtcgacaaatccaaattgcccagccgccacgtgactgaaggcccgtctcgcgcgccgcaccggtcctatttttatgcgatgggcctggacgaacatgagatcgcacagccttgggtcggtgtcgccacctgctggaacgaagcagccccctgcaacatcacgctgaaccggcaggcccaagccgtcaaggtcggcgtcaagaacgccaaaggcacgccgcgcgaatttaccacaatcaccgtcaccgatggcatcgccatgggccatgaagggatgcggtcgtcactcgcatcacgcgaagcgattgccgataccgttgaactgacgatgcgcggccattgctatgacgcgctggtcggtctggccggttgcgacaaatccttgcccgggatgatgatggcgatggtgcggctgaacgtgccgtcggtgttcatctatggcggctcaatcctgccgggccggttaaacgggcaggacgtgaccgtccaagacgtgttcgaagcggtgggcaagcatcaggccggtaatatgaccgatgcggagctcgaaatccttgaacgcgtcgcctgcccctctgctggggcttgtggtggacaattcaccgccaacaccatggcctgcgtgtccgaagcaatcggtctggcgctgctcaattcctctggcgcgcctgcgccctacgaatcgcgcgatcaatatggtgtcgcttcgggcgaggccgtgatgaacctgatcgccaagaacatccgcgcgcgcgatatcgtcacgcgcaaatcactggaaaacgcggcacggatcgtggcctgcaccggcgggtccaccaatgccggtctgcacctgcctgcgatcgccgccgaggctggcattgattttgatctgtccgatgtctgcgagattttccgcgatacgccctatttcgtcgatctcaaaccgggcggcaaatatgtggccaaggatctttacgaggcaggcggcgtgcctgtcgtgctgaaagaactgcgcaaggccggtctgatccacgaagattgcatgacagcgacaggccgcgtgatcggtgaagaactggacatgatcaagggtgaggcggataaccgcgtcatctattccgtcgccaatccgatcacgaaaaccggcggtgttgtcggcctgaaaggcaaccttgcccccgaaggcgccatcgtcaaggtcgcgggcatgtccgaggaagaacagatatttaccggccctgcccgcgtgttcgaatgcgaagaagacgcgttcgaggccgtaaaagcccgccaatatgaagaaggcgaagtcatcgttatccgcaacgaaggccctgcaggcggccccggtatgcgcgaaatgctgtccaccaccgccgctttgtcgggccaaggcatgggcaaaaaggtcgcgctgatcaccgacggccgcttttcaggtgcgacacgcgggttctgcgtgggtcacgtcggcccagaggccgcgcagggcggccccatcgcgctgttgaaagacggcgacatgatcacgctgaacgcgcgcaccggcgaattgtcggtggcgctgaccgatgcagaactggccgaacggcgcaaaacctgggctggcccgcgcgaaactatctatgcctcgggagccttgtggaaatatgcacagctggtcggatcgacccgtctgggcgcattgacccatccaggtgccaagggcgaaaaacacatctatatggacctgtaa

SEQ ID NO: 72 - protein, 577 aa, Loktanella vestfoldensis
MPSNRVDKSKLPSRHVTEGPSRAPHRSYFYAMGLDEHEIAQPWVGVATCWNEAAPCNITLNRQAQAVKVGVKNAKGTPREFTTITVTDGIAMGHEGMRSSLASREAIADTVELTMRGHCYDALVGLAGCDKSLPGMMMAMVRLNVPSVFIYGGSILPGRLNGQDVTVQDVFEAVGKHQAGNMTDAELEILERVACPSAGACGGQFTANTMACVSEAIGLALLNSSGAPAPYESRDQYGVASGEAVMNLIAKNIRARDIVTRKSLENAARIVACTGGSTNAGLHLPAIAAEAGIDFDLSDVCEIFRDTPYFVDLKPGGKYVAKDLYEAGGVPVVLKELRKAGLIHEDCMTATGRVIGEELDMIKGEADNRVIYSVANPITKTGGVVGLKGNLAPEGAIVKVAGMSEEEQIFTGPARVFECEEDAFEAVKARQYEEGEVIVIRNEGPAGGPGMREMLSTTAALSGQGMGKKVALITDGRFSGATRGFCVGHVGPEAAQGGPIALLKDGDMITLNARTGELSVALTDAELAERRKTWAGPRETIYASGALWKYAQLVGSTRLGALTHPGAKGEKHIYMDL

SEQ ID NO: 73 - DNA, 1734 bp, Roseobacter sp.
atgcccaaagatcaggtcaataagacacacctgcccagccgccatgtgaccgaaggcccatcgcgcgcgccgcaccggtcgtatttttacgccatgggtctggatgaagaagcgatcaagcaaccttgggttggtgtcgcgacctgctggaacgaagcggccccttgcaacatcgccctgaaccgtcaggcgcagtcggtcaagctgggtgtgaaaaaggcgatgggcacgccgcgcgaatttacaacgattactgtcaccgacggcattgcgatggggcatgaagggatgcgctcttcgctggcgtcacgcgaagcaattaccgatacggttgagctgacgatgcgcggccactgctatgatgcgctggtcggtctggccggttgcgacaaatccctgcccggtatgatgatggcgatggtccgtctgaacgtgccgtccgtctttatctatggcgggtccattctgccgggtcgtctggatggcaaggacgtgactgttcaggacgtgttcgaggctgtgggtaaacaccaagcgggcaatatgactgatgcggaactggaagtgctggaacgtgtagcgtgtccatctgctggcgcttgcggtggtcagtttacggccaatacgatggcttgtgtgtccgaagcgattggtctggccctgatgaattcttccggtgcccctgccccttatgaaagccgcgaccagtatggcattgcatcgggtgaagcggtcatgaacctgattgaaaagaacatccgcgcccgtgatgttgtcacccgcaagtcgcttgagaacgccgcgcgcgttgtggcctgtaccggtgggtccaccaatgccggtctacacctgccggccattgcgcatgaggctggcattgatttcgacctttttgatgtctgcgacatcttccgtgatacgccttattttgtcgatctgaaaccgggtggtcaatatgtggccaaagacctttacgaggctggcggcgtacccgtcgtgctgaaagaactgcgcaaggccggtctgatccacgaggagtgcatgacagcatcaggccggaccatgggcgaagagctggatatgatcaaaggcgaggcggacaataaggtgatctattctatcgaaaacccgctgacaccaaccggtggcgttgttggtttgaagggtaatcttgcccccgaaggtgcgattgtgaaggtcgcggggatgaatacgcaagaacagtcttttacaggtcccgcccgttgctttgaaagcgaagaagatgcgtttgaggctgtgaaagcccgccaatacgaagaaggcgaagtgctggtgatccgcaatgaaggccccgccggtggccccggtatgcgcgagatgctggcgacgactgccgcactgtccggccaaggcatgggcaaaaaggtcgcgctgatcacggatggccgcttttctggtgcgacacgcgggttctgtgtgggtcatgtggggccagaggccgcgcacggtggcccgataggcctgttgcagaacggcgatgtcatcacaatcaacgctgtcactggtgaactgtcagtcgatctgagtgacgaagaactggcgacgcgcaaggcgaattggaaaggcccgaaagagacgatctatgcatccggtgctttgtggaaatacgcgcaacttgtgggtggtgcgcgtttgggtgcggtgacgcatccgggtgcgaagtctgaaaaacacatttacatggacctctga

SEQ ID NO: 74 - protein, 577 aa, Roseobacter sp.
MPKDQVNKTHLPSRHVTEGPSRAPHRSYFYAMGLDEEAIKQPWVGVATCWNEAAPCNIALNRQAQSVKLGVKKAMGTPREFTTITVTDGIAMGHEGMRSSLASREAITDTVELTMRGHCYDALVGLAGCDKSLPGMMMAMVRLNVPSVFIYGGSILPGRLDGKDVTVQDVFEAVGKHQAGNMTDAELEVLERVACPSAGACGGQFTANTMACVSEAIGLALMNSSGAPAPYESRDQYGIASGEAVMNLIEKNIRARDVVTRKSLENAARVVACTGGSTNAGLHLPAIAHEAGIDFDLFDVCDIFRDTPYFVDLKPGGQYVAKDLYEAGGVPVVLKELRKAGLIHEECMTASGRTMGEELDMIKGEADNKVIYSIENPLTPTGGVVGLKGNLAPEGAIVKVAGMNTQEQSFTGPARCFESEEDAFEAVKARQYEEGEVLVIRNEGPAGGPGMREMLATTAALSGQGMGKKVALITDGRFSGATRGFCVGHVGPEAAHGGPIGLLQNGDVITINAVTGELSVDLSDEELATRKANWKGPKETIYASGALWKYAQLVGGARLGAVTHPGAKSEKHIYMDL

SEQ ID NO: 75 - DNA, 1734 bp, Dinoroseobacter shibae
atgctcaagcgttcgttcgacaagtccaagctgcccagccgtcacgtcaccgaaggcccttcgcgcgcgccgcatcggtcctattactatgccatgggcatgaccgaggaagagatccaccagccgctggtcggggtcgccacatgctggaacgaggccgcgccctgcaacatcgcgctcagccgccaggcccaggcggtgaagatgggggtcaagcaggcctccggcacgccacgagaattcaccacgatcaccgtgaccgacgggatcgccatgggccacgagggcatgcggtcctcgctggcctcccgcgaggcgattgccgatacggtcgaattgaccatgcgcggccattgctatgacgcgattgtgggtctggcgggctgcgacaagtccctgccggggatgatgatggccatggtgcggctcaacgtgccgtcggttttcatttatggcggctcgatcctgccgggtcggttgaacggcgaggacgtgacggttcaggacgtgttcgaggccgtgggcaagcaccaggccgggaactacaccgatgcagagctggaagtgctggagcgggtggcttgtccgtccgcaggggcctgtggcggtcagttcaccgccaataccatggcctgcgtgtccgaggcgatcggtctggcgctgccgaattccgcgggcgcacccgcgccctacgagagccgcgaccagtatggcgaggcgtcgggccgcgcggtcatggacctgatcgagaaaggcatccgcgcgcgggacatcgtgacccggaagtcgctggagaatgccgcgcggatcgtggcctgcaccggcgggtcgacgaatgccggtctgcacctgcctgcgattgcccatgaggccgggatcgaattcaccttgcaggatgtctgcgacatcttccgagacacgccctatttcgtggacctcaagccgggcggcaaatacgttgccaaggacatgtacgaagcgggcggcgtgcccgtggtgatgcgcgagctgcgccgcgcgggcctgatccacgaggattgcatgaccgtgaccggctattccatcggcgaggagctcgacaaggtcacgctcgaagccgatggccgggtgatctatccggtcgacacgccgctctcgaccacgggcggggttgtcggtctcgagggtaacctggcgcccgaaggtgccatcgtgaagatcgcgggcatgagcgacgaccagttggtcttcaccggcccggcgcgcgtgttcgaatgcgaagaggacgccttcgaggcggttcagaaccgcgcttacgcggaaggcgacgtcttcgtgatccgcaacgagggtcccgcaggcggtcccggcatgcgcgagatgctggccaccacggcggcgctctcgggtcagggcatgggcaagaaggtggcgctgatcaccgatggccggttctccggggccacgcgcggcttctgcgtcggccatgtgggccccgaagcggcccatggcggccccatcgcgatgctcaaggacggcgacatgatcaccatcgacgcgctgaagggcgagctgtccgtcgcgctgagcgaggatgagcttgccgcgcgaaaagatgcctggagcggcccgcgggagacgatctatgcctcgggtgcgttgtggaaatatgcgcagctggttggcggcgcacgcctgggggcagtcacccatcccggagccaaggatgaaaaacacatctacgccgatctctga

SEQ ID NO: 76 - protein, 577 aa, Dinoroseobacter shibae
MLKRSFDKSKLPSRHVTEGPSRAPHRSYYYAMGMTEEEIHQPLVGVATCWNEAAPCNIALSRQAQAVKMGVKQASGTPREFTTITVTDGIAMGHEGMRSSLASREAIADTVELTMRGHCYDAIVGLAGCDKSLPGMMMAMVRLNVPSVFIYGGSILPGRLNGEDVTVQDVFEAVGKHQAGNYTDAELEVLERVACPSAGACGGQFTANTMACVSEAIGLALPNSAGAPAPYESRDQYGEASGRAVMDLIEKGIRARDIVTRKSLENAARIVACTGGSTNAGLHLPAIAHEAGIEFTLQDVCDIFRDTPYFVDLKPGGKYVAKDMYEAGGVPVVMRELRRAGLIHEDCMTVTGYSIGEELDKVTLEADGRVIYPVDTPLSTTGGVVGLEGNLAPEGAIVKIAGMSDDQLVFTGPARVFECEEDAFEAVQNRAYAEGDVFVIRNEGPAGGPGMREMLATTAALSGQGMGKKVALITDGRFSGATRGFCVGHVGPEAAHGGPIAMLKDGDMITIDALKGELSVALSEDELAARKDAWSGPRETIYASGALWKYAQLVGGARLGAVTHPGAKDEKHIYADL

SEQ ID NO: 77 - DNA, 1728 bp, Roseovarius nubinhibens
atgaccaaattcgacaaagcaaaattgcccagccgccatgtgaccgaaggcccggcgcgtgcgccgcaccggtcctacatgtatgcgatggggcttcaggaagaagaaatccatcagcctctggtcggcgtggcgacctgctggaacgaggcggcgccgtgcaacatttcgctcaaccggcaggcgcaatcggtcaagatgggcgtcaaggaagcgggcggcacgccgcgcgagtttaccaccatcaccgtgaccgacggcatcgccatgggccatgagggcatgcgcagctcgctcgcgtcgcgcgaggcgattgccgacactgtcgagctcaccatgcgcggccattgctatgatgcgctcgtcggtctggcgggctgtgacaagtcgctgccggggatgatgatggcgatggtgcggctcaacacgccgtcggtcttcatctatggcggctcgatcatgccgggccggttccagggccgtgacgtgaccgtgcaggacgtgttcgaggccgtcggccgccatcaggcaggggccaattcggacgaagagctgcgggcgctggaaaaggtggcctgcccgtcggccggggcctgtggcggccagttcaccgccaacaccatggcctgtgtctctgaagcgatcggtctggcgctgcccaactcggcgggcgcgcccgcgccctatgaaagccgcgatcaatatggcaccgcctctggtgcggcggtcatgacgcttttggaaaagaacatccgggcgcgcgacatcgtcacgctcaagagccttgagaatgccgcgcgggtcgtggcctgtaccggtgggtcgaccaatgccggtctgcacctgcccgcgattgcgcatgaggcggggctcgagtttttcctcgatgacgtctgccagatcttcaaggacacgccctatttcgtcgatctcaaaccgggcgggcaatatgtcgccaaggacctctatgaggcgggcggcgtgccggtggtgatgaaggagctgcgcaaggcggggctcatccacgaagattgcatgaccgtcaccgggcggaccattggcgaagagatcgacatcgtcgagcgcgaggccgatggccgggtgatctatcccgtcgagaagccgatcaccaagaccggcggcgtcgtgggcctcaagggcaatcttgccccgcagggcgccatcgtgaaggtcgcgggtatgagcgaggaagagcaagtcttctcgggccccgcgcgggtttttgaatgcgaagaggacgcctttgaggcggtcaaggcgcgcagctacaaggagggcgaggttctcgtcatccgcaacgagggccccgcaggcggtccgggcatgcgcgagatgctcgccaccacggcggcgctgtcggggcagggcatgggcaagaaggtcgcgctcatcaccgatggccggttctcgggcgcgacgcgtggcttctgcgtcggccatgtcggaccggaatcggcccatggcggcccgattgccctggtccaggatggcgatgtgatcaccatcaacgcgatcaccggcgagctcagcgtggcgctcagcgatgaggatctgacggcccgcaaggaggcctggaaaggcccgcgcgagacgatctattccagcggcgcgctgtggaaatacgcccagctcgtgggcgagacctacaagggcgctgtgacccaccccggtgccgaagcggagaagcatgtctatatggatctctaa

SEQ ID NO: 78 - protein, 575 aa, Roseovarius nubinhibens
MTKFDKAKLPSRHVTEGPARAPHRSYMYAMGLQEEEIHQPLVGVATCWNEAAPCNISLNRQAQSVKMGVKEAGGTPREFTTITVTDGIAMGHEGMRSSLASREAIADTVELTMRGHCYDALVGLAGCDKSLPGMMMAMVRLNTPSVFIYGGSIMPGRFQGRDVTVQDVFEAVGRHQAGANSDEELRALEKVACPSAGACGGQFTANTMACVSEAIGLALPNSAGAPAPYESRDQYGTASGAAVMTLLEKNIRARDIVTLKSLENAARVVACTGGSTNAGLHLPAIAHEAGLEFFLDDVCQIFKDTPYFVDLKPGGQYVAKDLYEAGGVPVVMKELRKAGLIHEDCMTVTGRTIGEEIDIVEREADGRVIYPVEKPITKTGGVVGLKGNLAPQGAIVKVAGMSEEEQVFSGPARVFECEEDAFEAVKARSYKEGEVLVIRNEGPAGGPGMREMLATTAALSGQGMGKKVALITDGRFSGATRGFCVGHVGPESAHGGPIALVQDGDVITINAITGELSVALSDEDLTARKEAWKGPRETIYSSGALWKYAQLVGETYKGAVTHPGAEAEKHVYMDL

SEQ ID NO: 79 - DNA, 1734 bp, Sagittula stellata
gtgctcaagcgtccgtttgacaagaccaaactgcccagccgtcacgtcactgagggtcccgcccgcgcgccgcatcgctccttcatgtacgccatggggttgagcgaagaagagatccatcagcctcttatcggtgtcgcgacctgctggaacgaggccgcgccctgcaacatctcgctgagccggcaggcgcaggcggtgaagctgggtgtcaaggaagcctccggcacgccgcgcgaattcaccaccatcaccgtgaccgacggcatcgcgatgggccacgaggggatgcgtgcttcgctggcctctcgcgaagccatcgccgatacggtcgagctgacgatgcgcggccactgctacgacgcgcttgtggggcttgcgggctgcgacaagtcactgcccgggatgatgatggcaatggtgcggctcaatgtgccgtcggtcttcatctatggcgggtcgatcatgccgggcaagttccagggccgcgacatcaccgttcaggacgtgttcgaggccgtgggcaagcaccaggcgggcgccaactccgacgaggaactgcgcgccatcgagaaggcggcctgtccctcggccggggcctgcggcggccagttcaccgccaacaccatggcctgcgtgtccgaggccatcggccttgcgttgttgaattcttccggcgcgccagcgccttacgaaagccgcgaccagtacggcaccgcgtccggcatcgccgtgatgaacctgctggagcgcaacatccgcgcccgcgacatcgtcacgatgaagtctctggaaaacgcggcgcgggtggtcgcctgcaccggcggttcgaccaacgccggtctgcacctgcccgccatcgcacatgaggcagggctggaattcttcctagacgacgtgtgcgagatcttccgcgacacaccctatttcgtcgacctgaagcccggcggcaactatgtggccaaggacctttacgaggtcggtggcgttccggttgtgatgaaggagctgcgcgaggcgggcctgatccacgaggactgcatcaccgcatcggggcgatcaatgggagaggaactcgacctgatcgagcgcgaggccgatggcaaagtcatctatcccatagaaacgccgatcaccaagaccggcggcgtcgtgggcctgaagggcaacctcgccccgcagggcgccatcgtgaaggtcgcgggaatcgcggcggaggaccaggtgttcaccggtcccgcgcgtgtcttcgaatgcgaggaagactgctttgaagcggtcaagatgcgcgcctacaaggagggcgaggtgctggtcatccgcaacgagggccccgcaggcggccccggcatgcgcgagatgctggctaccaccgccgccctgtccgggcagggtatgggcaagaaggttgcactgatcaccgacggccgcttttccggtgcgacgcgcggtttctgcgtgggccacgtcggcccagaggcggcgcacggcgggccgatcgcgctggtggaaaccggcgatgtcatcaccatcaacgcacagaccggagagctgtccgtggacctgacggacgagcaactggcggcccgcaaggacgcttggagcgggccgcgggacacgatctatgcctccgggtcgctgtggaaatatgcgcaactcgttggggagacatacaaaggcgccgtcacccatccaggtggcaaggcggagaaacacgtctacgccgatctctga

SEQ ID NO: 80 - protein, 577 aa, Sagittula stellata
MLKRPFDKTKLPSRHVTEGPARAPHRSFMYAMGLSEEEIHQPLIGVATCWNEAAPCNISLSRQAQAVKLGVKEASGTPREFTTITVTDGIAMGHEGMRASLASREAIADTVELTMRGHCYDALVGLAGCDKSLPGMMMAMVRLNVPSVFIYGGSIMPGKFQGRDITVQDVFEAVGKHQAGANSDEELRAIEKAACPSAGACGGQFTANTMACVSEAIGLALLNSSGAPAPYESRDQYGTASGIAVMNLLERNIRARDIVTMKSLENAARVVACTGGSTNAGLHLPAIAHEAGLEFFLDDVCEIFRDTPYFVDLKPGGNYVAKDLYEVGGVPVVMKELREAGLIHEDCITASGRSMGEELDLIEREADGKVIYPIETPITKTGGVVGLKGNLAPQGAIVKVAGIAAEDQVFTGPARVFECEEDCFEAVKMRAYKEGEVLVIRNEGPAGGPGMREMLATTAALSGQGMGKKVALITDGRFSGATRGFCVGHVGPEAAHGGPIALVETGDVITINAQTGELSVDLTDEQLAARKDAWSGPRDTIYASGSLWKYAQLVGETYKGAVTHPGGKAEKHVYADL

SEQ ID NO: 81 - DNA, 1758 bp, Roseobacter sp.
atgaccaaattcgacaaatccaaactgcccagccgttacgtgaccgaaggaccggcccgcgcgccgcatcggtcctattactatgccatgggcatgaccgaggccgagatccatcagccgctggtcggcgtggcgacctgctggaacgaggcggcgccgtgcaacatcgcgctcaaccgtcaggcgcaggccgtcaagggcggcgtcaaggaagcgcatggcagcccgcgtgaattcaccacgatcaccgtgaccgacgggatcgccatgggccatgaaggcatgcgcagctcgcttgccagccgcgaggcgattgccgacactgtcgagctgaccatgcggggccattgctatgacgcgcttgtgggtcttgcgggctgtgacaagtcgctgccgggcatgatgatggcgatggtgcggctcaatgtgccgtcagtgttcatctatggcgggtcgatcctgccgggcaaggcgcctcaggtgaacgaaatccccgaagaattccgcaaccgcgacctgacggtgcaggatatgttcgaagcggtcggctggcaccagaacgagcagatgtccgacaaggcgctcgatatgctcgaacgcgtcgcctgcccctcggcgggcgcttgcggcgggcagttcaccgccaacacaatggcctgcgtctccgaggcgatcggccttgcgctgatgaacagctcgggcatgcccgcgccctacgaatcccgcgaccaatatgccgaggcgtcgggccgcgcggtcatgacccttctggaaaagaacatccgtgcgcgggacgtggtcaccctccaaagcctgcagaacgccgcgcgcgtcgtggcctgcaccggcggctccaccaatgcgggcctgcaccttccggccatcgcccatgaggcggggatcgacttcttcctcgaagatgtctgcgagattttccgcgacacgccctatttcgtcgatctcaagcccggtggtcagtatgtggccaaggatctctatgatgcgggcgggattcccgtcgtgatgaaagagctgcgcaaggcggggctgatccacgaggattgcatcaccgcctcgggccgctccatcggcgaagagcttgacctgatcgaacgcgaggccgatggccgcgtgatctatccgatcgaaaagccgatcaccaagaccggcggtgtcgtcggcctcaagggcaatcttgcgccgcaaggcgccatcgtgaaggtcgcgggcatcgcccccgagcatcaggtcttcaccggcccggcgcgcgtgttcgaatgcgaagaggacgcgttcgaggcggtcaaggcgcgccaatacaaggaaggcgaggtcatcgtgatccgcaacgaaggccccgcaggcggccccggcatgcgcgagatgctgtccacgaccgccgcgctgtccgggcagggcatgggcaagaaggttgcgcttatcaccgatgggcgcttttcgggcgccacacgcgggttctgtgtgggccatgtcggccccgaggcggcgcatggtggcccgatcgccctgatccagaccggcgatgtggtcaccatcgacgcgatcaagggcgaactgagcgtcgatctatcggacgaggagctggccaagcgcaaggaaaactgggccggcccgcgcgagacgatctatgccaccggtgcgatctggaaattcgccaagcttgtgggcgagacctacaagggggctgtcacccatcccggcggcaaggccgagcggcatgtctacatggacctctga

SEQ ID NO: 82 - protein, 585 aa, Roseobacter sp.
MTKFDKSKLPSRYVTEGPARAPHRSYYYAMGMTEAEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVNEIPEEFRNRDLTVQDMFEAVGWHQNEQMSDKALDMLERVACPSAGACGGQFTANTMACVSEAIGLALMNSSGMPAPYESRDQYAEASGRAVMTLLEKNIRARDVVTLQSLQNAARVVACTGGSTNAGLHLPAIAHEAGIDFFLEDVCEIFRDTPYFVDLKPGGQYVAKDLYDAGGIPVVMKELRKAGLIHEDCITASGRSIGEELDLIEREADGRVIYPIEKPITKTGGVVGLKGNLAPQGAIVKVAGIAPEHQVFTGPARVFECEEDAFEAVKARQYKEGEVIVIRNEGPAGGPGMREMLSTTAALSGQGMGKKVALITDGRFSGATRGFCVGHVGPEAAHGGPIALIQTGDVVTIDAIKGELSVDLSDEELAKRKENWAGPRETIYATGAIWKFAKLVGETYKGAVTHPGGKAERHVYMDL

SEQ ID NO: 83 - DNA, 1758 bp, Roseovarius sp.
atgaccaagttcgacaaagccaaactgcccagccgtcacgtgaccgaagggcccgagcgcgcgccgcatcggtcctattactatgccatgggcatgaccgagacggaaattcatcagccgctcgtgggcgtggcgacctgctggaacgaagcagccccctgcaacatcgcgctgaaccgtcaggcgcaggcggtcaagggtggcgtgaaagaggcgcatggcagcccgcgtgagtttaccacgatcacggtcacggacgggattgcgatggggcatgagggcatgcggtcgagccttgcgagccgggaggcaattgccgatacggtggaattgaccatgcgtggacattgctatgacgcgctggttggtttggcgggttgtgacaaatccctgcctggaatgatgatggcgatggtgcggttgaacgtgccgtccgtgttcatttatggcgggtcgatcctgccgggcaaggccccgcaggtcgaggagattccggcggatttccgcagccgtgatctgaccgtgcaggacatgttcgaggcggtggggcggcatcagaacaacgagatgtccgacaaggcgctggatatgctggagcgggtggcctgcccatcggcgggggcctgtggcgggcagttcaccgccaacaccatggcctgtgtttctgaggcgattggtctggcgttgatgaattcctcgggtatgcctgccccttatgaaagccgcgatcaatatgccgaggcgtctggtcgtgcggtgatgcatcttttggagcgcaacatccgggcgcgggacgtggtgacgctcaagtcgttgcagaatgcggcgcgggttgtggcctgcaccggtggcagcaccaatgccggtttgcacctgcctgcgattgcgcatgaggcggggattgatttctttctcgaagatgtctgcgacatcttccgcgacacgccctatttcgtcgatctgaaaccgggcggggcctatgtggccaaagacctttatgatgccggtggtatcccggttgtgatgaaggaattgcgcaaggccggtctgattcatgaggattgcatcaccgcgagcgggcgcagcatcggcgaggagctggacctgatcgagcgcgaagccgatggcaaggtcatctatccgattgaaacgccgatcaccaagacggggggcgttgtcggtctcaagggcaatctggccccgaccggcgcgattgtgaaagtggcgggcattgcgcccgagcatcaggtctttaccggcccggcgcgggtgtttgaatgtgaagaagacgcattcgaggccgtcaaagcgcgcgcctataaagagggcgaggtgatcgtcatccgcaatgaaggcccggcaggcggccccggcatgcgcgagatgctgtcgaccacagcggcgctgagcggtcagggcatgggcaagaaggtggcgctgatcaccgacgggcggttctctggggcgacacgcgggttctgtgtgggccatgttggaccagaggccgcgcatggtggcccgattgccttgattgccacgggcgacatgatcacgattgacgcgatcaagggggaattgtcggttgatctgagcgacgaggaactggccaagcgcaaggacgcttggggcgggccgcgcgagacgatctataccagcggggcgctgtggaaatatgcgcaattggtgggcgagacctataagggcgctgtgacccatcccggcgcagcgttcgagcggcatgtctatatggacctctga

SEQ ID NO: 84 - protein, 585 aa, Roseovarius sp.
MTKFDKAKLPSRHVTEGPERAPHRSYYYAMGMTETEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNNEMSDKALDMLERVACPSAGACGGQFTANTMACVSEAIGLALMNSSGMPAPYESRDQYAEASGRAVMHLLERNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCITASGRSIGEELDLIEREADGKVIYPIETPITKTGGVVGLKGNLAPTGAIVKVAGIAPEHQVFTGPARVFECEEDAFEAVKARAYKEGEVIVIRNEGPAGGPGMREMLSTTAALSGQGMGKKVALITDGRFSGATRGFCVGHVGPEAAHGGPIALIATGDMITIDAIKGELSVDLSDEELAKRKDAWGGPRETIYTSGALWKYAQLVGETYKGAVTHPGAAFERHVYMDL

SEQ ID NO: 85 - DNA, 1758 bp, Oceanicola batsensis
atgacgaaattcgacaaatcccggctgcccagccgatacgtcaccgaaggacccgagcgcgcgccgcaccgctcctacctctatgccatggggatttccgaagaagagatccaccagccgctcgtcggcgtggcgacctgctggaacgaggccgcgccctgcaacatcgcgctgaaccgccaggcgcaggccgtcaagctgggcgtgaaggcgcgcgaaggcacgccgcgcgaattcaccaccatcaccgtcaccgacggcatcgccatgggccacgaggggatgcgatcctccctcgcctcgcgcgaggccatcgccgacacggtggagctgaccatgcgcggccactgctacgacgcgatcgtcggactggcgggctgcgacaagtccctgcccggcatgatgatggccatggtacgtctgaacgtgccctcggtcttcatctacggcggttcgatcctgcccggcaaggcaccgcaggtcgacgagatccccgaggacttccgcacccgcgacctgaccgtgcaggacatgttcgaagcggtcggccgtcaccagaacaaggagttgtcggacgctgcgctcgacatgctggaacgggtggcctgcccctcctccggcgcctgcggcggccagttcaccgccaataccatggcctgcgtctccgaggcgatcgggctggcgctgctcaactcctccggcatgcctgcgccctacgagagccgcgaccagtacggcgaggcctcgggccgcgcggtcatgaacctgatcgagaagaacatccgcgcccgcgatgtcgtcacccgcaagtcgctggaaaacgccgcgcgcgtcgtggcctgcaccggcggctcgaccaacgccggcctgcacctgcccgcgatcgcgcacgaggccggcatcgactttcaccttgatgacgtctgcgagatcttccgcgacacaccctatttcgtgaacctcaagccgggcggcgaccacgtggccaaggacctgttcgacgtcggcggcatcccggtggtgatgaacgaactgcgcaaggccggcctgatccacgaggactgcgtcacggcctcgggcaagaccatcggcgaggaactcgacaccgtcacccgcaaggccgacggcaaggtgatctatccgatcgagacgccgatcaccaagaccggcggcgtggtgggcctcaagggcaacctcgcccccgaaggcgccatcgtgaaggtcgcgggcatttcggccgaggatcagaagttcaccggccccgcccgggtcttcgaatgcgaggaagacgcctttgccgccgtgcagaaacgggaatacgaggaaggcgaggtcatcgtcatccgcaacgagggccccgcgggcggtcccggcatgcgcgagatgctggccaccaccgccgccctgtccggccagggcatgggcaagaaggtcgcgctgatcaccgacggccgcttttccggcgcgacgcgcggcttctgcgttggccatgtcggccccgaggcagcgcatggcggcccgatcgcgatgctcaagaacggcgacatgatcaccatcgacgccatcgagggttcgatcgaggtcgacctctccgaggccgaactcgaggcgcgcaaggccgactggacgggccctcgcgagacgatctacgcctcgggcgcgctctggaaatatgcgcagctggtcggcaagacctatctcggcgctgtcacccatcccggcggcaaggccgagaaacatatctatgccgatctctga

SEQ ID NO: 86 - protein, 585 aa, Oceanicola batsensis
MTKFDKSRLPSRYVTEGPERAPHRSYLYAMGISEEEIHQPLVGVATCWNEAAPCNIALNRQAQAVKLGVKAREGTPREFTTITVTDGIAMGHEGMRSSLASREAIADTVELTMRGHCYDAIVGLAGCDKSLPGMMMAMVRLNVPSVFIYGGSILPGKAPQVDEIPEDFRTRDLTVQDMFEAVGRHQNKELSDAALDMLERVACPSSGACGGQFTANTMACVSEAIGLALLNSSGMPAPYESRDQYGEASGRAVMNLIEKNIRARDVVTRKSLENAARVVACTGGSTNAGLHLPAIAHEAGIDFHLDDVCEIFRDTPYFVNLKPGGDHVAKDLFDVGGIPVVMNELRKAGLIHEDCVTASGKTIGEELDTVTRKADGKVIYPIETPITKTGGVVGLKGNLAPEGAIVKVAGISAEDQKFTGPARVFECEEDAFAAVQKREYEEGEVIVIRNEGPAGGPGMREMLATTAALSGQGMGKKVALITDGRFSGATRGFCVGHVGPEAAHGGPIAMLKNGDMITIDAIEGSIEVDLSEAELEARKADWTGPRETIYASGALWKYAQLVGKTYLGAVTHPGGKAEKHIYADL

SEQ ID NO: 87 - DNA, 1764 bp, Oceanicola granulosus
atgctcaagggcaagctggacaagtcgaaactgccgagccgccatgtgaccgacggtccggcccgcgcgccgcatcggtcctacctctacgcgatgggcctctcggacgaggagatcgcgcagccgctggtcggcgtcgccacctgctggaacgaggccgcgccctgcaacatcgcgctgaaccggcaggcgcagtcggtcaagctgggcgtgcgcgccgcctcgggcacgccgcgcgagttcaccacgatcaccgtcaccgacgggatcgccatgggccacgaggggatgcgctcgtcgctggcgagccgcgaggcgatcgccgacaccgtcgagctgaccatgcgcggccattgctacgacgcgctcgtcgggctcgcgggctgcgacaagtcgctgccggggatgatgatggcgatggtgcggctcaacgtgccgtcggtgttcatctacggcggctcgatcctgccgggcaaggtgccggccggcgccgacgtcccggccgacttcgccacccgcgacctgaccgtgcaggacatgttcgaggcggtcggccggcaccaggccggcgatctgtccgatgccgcgctcgacgtgctcgagcgggtcgcctgcccctccgccggggcctgcggcggccagttcaccgccaacaccatggcctgcgtctccgaggcgatcggcctggcgctgatgaactcctccggcgcgcccgcgccctacgagagccgcgaccagtacagcgtcgcctcgggcgaggcggtgatgaagcttctcgagagcaacatccgcgcccgcgacgtcgtcacccgcaagagcctcgagaacgccgcccgggtcgtcgcctgcaccggcggctcgaccaacgccggcctgcacctgccggccatcgcgcacgaggcggggatcgacttcgacctgttcgacgtctgcgacatcttccgcgacaccccctacttcgtcgacctcaagcccggcggccagtacgtggctaaggacctgttcgaggccggcggcgtgcccgtggtgatgaaggagctgcgcaaggccgggctgctgcacgaggactgcatcaccgccagcggcgagacgctcggcgaggcgctcgacaagatcaccggcgaggccgacggccgcgtcatccatcccgtcgccaccccgatcagcaagaccggcggcgtcgtcgggctgaagggcaacctcgccccggaaggtgcgatcgtgaaggttgccggcatggacgccgagcagcaggtcttcaccggcccggcgcgggtgttcgagtgcgaggaggacgccttcgaggcggtcaaggcgcgcagctacaaggaaggcgaggtcatcgtcatccgcaacgagggccccgccggcggccccggcatgcgcgagatgctggccaccaccgccgcgctctccgggcagggcatgggcaagaaggtcgcgctcatcaccgacggccgcttctcgggcgcgacgcgcggcttctgcgtcggccatgtcggccccgaggccgcccatggcgggccgatcgcgatgctcgagaatggcgacatgatcaccatcgacgccatcaagggcgagatctccgtcgcgctgaccgaggagcagttcgccgagcgcaaggccgcctggccgggcgcgcgcaagacggactacgcctcgggcgcgctgtggaagtacgcccagctcgtcggctccacccgtctcggcgcggtgacccatccgggcgcgaaggcggagacgcacgtctacatggatctctga

SEQ ID NO: 88 - protein, 587 aa, Oceanicola granulosus
MLKGKLDKSKLPSRHVTDGPARAPHRSYLYAMGLSDEEIAQPLVGVATCWNEAAPCNIALNRQAQSVKLGVRAASGTPREFTTITVTDGIAMGHEGMRSSLASREAIADTVELTMRGHCYDALVGLAGCDKSLPGMMMAMVRLNVPSVFIYGGSILPGKVPAGADVPADFATRDLTVQDMFEAVGRHQAGDLSDAALDVLERVACPSAGACGGQFTANTMACVSEAIGLALMNSSGAPAPYESRDQYSVASGEAVMKLLESNIRARDVVTRKSLENAARVVACTGGSTNAGLHLPAIAHEAGIDFDLFDVCDIFRDTPYFVDLKPGGQYVAKDLFEAGGVPVVMKELRKAGLLHEDCITASGETLGEALDKITGEADGRVIHPVATPISKTGGVVGLKGNLAPEGAIVKVAGMDAEQQVFTGPARVFECEEDAFEAVKARSYKEGEVIVIRNEGPAGGPGMREMLATTAALSGQGMGKKVALITDGRFSGATRGFCVGHVGPEAAHGGPIAMLENGDMITIDAIKGEISVALTEEQFAERKAAWPGARKTDYASGALWKYAQLVGSTRLGAVTHPGAKAETHVYMDL

SEQ ID NO: 89 - DNA, 1728 bp, Rhodobacterales bacterium
atgacgaaatttgacaaaaccaacctgcccagccgccatgtaaccgagggtcctgcgcgtgcgccgcatcgttcgtatttatatgctatggggttgtctgaagatgaaattcaccagcctctagtcggtgttgccacatgctggaacgaggcggccccctgtaatatcgccctgaaccgtcaggcgcaatctgtgaaaatgggcgtcaaacaagcgatgggtacgccacgcgaattcaccacgattaccgttacagacggtattgcgatgggtcacgaaggtatgcgttcgtctttggccagccgcgaggcaatcgctgacacggttgaattgaccatgcgcggtcattgctatgatgcgatcgttggtcttgctggttgtgacaagtcattgcccggtatgatgatggcgatgatccgtttaaacacaccgtctgtgtttgtttatggcggttcaatcttgcccggtcgttacgagggtcgcgatgttactgtacaggacgtttttgaggccgtcggccagcaccaagctggaaacctttcgtcttgcgagcttgaaaaactagaagcggttgcttgtccttctgcgggtgcttgtggtggtcagtttaccgccaacaccatggcttgtgtttccgaggcaatcggtcttgccttgccaaattccgcgggcgcaccggcaccgtatgaaagccgtgatcaattctgcgaggcatccggccgcgctgttatgaatttgatcgccaaaaacattcgtgcgcgtgacatcgtaacacgtaaatcattggaaaatgcggcacgtgttgttgcttgtactggtggttcaacgaatgcaggtcttcacttgccagccatggcgcatgaggcaggcattgatttttatctggatgacgtttgtgacatcttccgcgaaacgccttatttcgtcgatctgaaaccaggtggtaattatgtagccaaagacctttatgaggttggtggcgttcccgtaattatgcgtgaattgcgcaaagcggggttgatccacgaggattgcatgacagccactggccgcacaatgggcgaagagattgatcttgttgatcgcgaagcggacggtaaagtgatttaccccgttgatgccccgttgacgaaaactggcggcgttgttggccttaaaggtaacttggccccagaaggcgcgattgtgaaagtggcgggtatcccatcacagcaccaagtgttttccggccctgcccatgtttttgaatgtgaacaggacgcttttgaagccgtgcaaaaccgtgactacaaagaaggcgaagtattcgtcattcggaacgaaggcccatcaggtggccctggcatgcgtgaaatgttggcaacgaccgccgccctttctggtcaaggcatgggtaaaaagatcgccctgattacagatggtcgcttttctggtgcaacacgtggtttctgtgttggtcacgttggaccagaggcggctcatggtggcccgattgcgttggttgaaaatggtgacatcatcaccatcaatgcaattgaaggcgaaatttcggttaatttgactgatgatgagttggctgaacgtaagacaaactggaaaggaccacgcgaaacgatctatgcgtctggtgctttgtggaaatacagtcagcaagttggcgaagtatacaagggtgctgttacccatccaggtggcaaagccgaaaaacacgtttacatggatttgtaa

SEQ ID NO: 90 - protein, 575 aa, Rhodobacterales bacterium
MTKFDKTNLPSRHVTEGPARAPHRSYLYAMGLSEDEIHQPLVGVATCWNEAAPCNIALNRQAQSVKMGVKQAMGTPREFTTITVTDGIAMGHEGMRSSLASREAIADTVELTMRGHCYDAIVGLAGCDKSLPGMMMAMIRLNTPSVFVYGGSILPGRYEGRDVTVQDVFEAVGQHQAGNLSSCELEKLEAVACPSAGACGGQFTANTMACVSEAIGLALPNSAGAPAPYESRDQFCEASGRAVMNLIAKNIRARDIVTRKSLENAARVVACTGGSTNAGLHLPAMAHEAGIDFYLDDVCDIFRETPYFVDLKPGGNYVAKDLYEVGGVPVIMRELRKAGLIHEDCMTATGRTMGEEIDLVDREADGKVIYPVDAPLTKTGGVVGLKGNLAPEGAIVKVAGIPSQHQVFSGPAHVFECEQDAFEAVQNRDYKEGEVFVIRNEGPSGGPGMREMLATTAALSGQGMGKKIALITDGRFSGATRGFCVGHVGPEAAHGGPIALVENGDIITINAIEGEISVNLTDDELAERKTNWKGPRETIYASGALWKYSQQVGEVYKGAVTHPGGKAEKHVYMDL

SEQ ID NO: 91 - DNA, 1734 bp, Paracoccus denitrificans
atgaaaaacagccgcttcgacaagtcgtccctgcccagccgccatgtgaccgaagggccggcccgcgcgccgcatcgcagctatttctatgccatgggcatatcggaggaagaaatccattccccctgggtgggcgtcgccacctgctggaacgaggccgcgccctgcaacatcgcgctggcccgacaggcgcaatcggtcaagcagggcgtcaagaagggtggcggctgcccgcgcgaattcaccaccatcaccgtcaccgacggtattgccatgggacatgaggggatgcgctccagcctcgcctcgcgcgatgccatcgccgatacggtcgagctgaccatgcgcgggcattgctacgacgcgctggtcgggctggcgggctgcgacaagtcgctgccgggcatgatgatggccatggtgcggctgaacgtgcccagcgtcttcatctatggcggctcgatcctgccgggcaagctcaacggccgcgacgtggtggtgcaggacgtgttcgaggcggtgggccagcacgcggccggcaacatgtccgatgccgagctggagatcctggagcgcgtggcctgcccctcggccggggcctgcggcgggcaatataccgcgaacaccatggcttgcgtgtcggaagccatcgggctggcgctgatgaacagctcgggcgcgccggcgccttacgaatcgcgcgaccagtatgggctggcctcgggcgaggcggtgatggcgctgatcgaaaggaacatccgtgcccgcgacgtggtgacgcgcaaatcgctggaaaacgcggcgcgggtggtggcctgcaccggcggctcgaccaatgccgggttgcacctgcccgccatcgcgcatgaggcggggatcgaattcgacctgttcgacgtctgcgagatcttccgcgacacgccctatttcgtgaacctgcgcccgggcggcgattacgtcgccaaggacttgttcgaggccgggggcgtcccggtcgtcatgcgcgaattgcgccgcgccgggctgatccacgaggattgcctgaccgcctcgggccgcagcatgggcgaggagctggacctggtcaagcgcgaggccgacggcaaggtgatccatccggtgacggcgccgctgtccaggaccggcggcgtggtcgggctgcgcggcaacctggcgcccgacggcgccatcgtgaaggtcgcgggaatggcgcccgagcaccaggtctttaccggccccgcccgggtcttcgaatgcgaggaagaggcgttcgaggccgtcgcccgccgcgattacagcgagggctgcgtgatcgtcatccgaaacgaggggccggccggcggccccggcatgcgcgagatgctggcgaccacggcggcgctgtcggggcagggcatgggcaagaaggtggcgctgatcaccgacgggcggttctcgggcgcgacgcgcggcttctgcgtcggccatgtcggtcccgaggcggcgcatggcggccccatcgccctgctgcgcgacggcgacatgatcaccatcgacgcgatcaggggcgagatctcggtggcgctgccggacgaggaactgacgcggcgccgcgccgcatgggcgggaccgcgcaagaccgactatgcctcgggcgcgctgtggaaatacgcccagttggtcggcaaggcgcgctatggcgcggtcacccatccgggcgcggcggccgaaacccatgtctatatggatcagtga

SEQ ID NO: 92 - protein, 577 aa, Paracoccus denitrificans
MKNSRFDKSSLPSRHVTEGPARAPHRSYFYAMGISEEEIHSPWVGVATCWNEAAPCNIALARQAQSVKQGVKKGGGCPREFTTITVTDGIAMGHEGMRSSLASRDAIADTVELTMRGHCYDALVGLAGCDKSLPGMMMAMVRLNVPSVFIYGGSILPGKLNGRDVVVQDVFEAVGQHAAGNMSDAELEILERVACPSAGACGGQYTANTMACVSEAIGLALMNSSGAPAPYESRDQYGLASGEAVMALIERNIRARDVVTRKSLENAARVVACTGGSTNAGLHLPAIAHEAGIEFDLFDVCEIFRDTPYFVNLRPGGDYVAKDLFEAGGVPVVMRELRRAGLIHEDCLTASGRSMGEELDLVKREADGKVIHPVTAPLSRTGGVVGLRGNLAPDGAIVKVAGMAPEHQVFTGPARVFECEEEAFEAVARRDYSEGCVIVIRNEGPAGGPGMREMLATTAALSGQGMGKKVALITDGRFSGATRGFCVGHVGPEAAHGGPIALLRDGDMITIDAIRGEISVALPDEELTRRRAAWAGPRKTDYASGALWKYAQLVGKARYGAVTHPGAAAETHVYMDQ

SEQ ID NO: 93 - DNA, 1767 bp, Oceanibulbus indolifex
atgtccaccaccccacgcttcgacaaatcccggctgcccagccgccacgtgaccgaaggcccggcccgcgcgccgcatcggtcttactactatgccatgggcatgaccgagcaagagattcaccagccgctggtgggcgtcgccacctgctggaacgaagcagcgccctgcaacatcgcgctgagccgtcaggcgcaggccgtgaagatcggtgtgcattccgaacagggcacgccgcgcgagtttaccacgatcaccgtcaccgatggtatcgcgatgggccacgagggcatgcgctcctcgctcgcgtcgcgcgaagcgattgccgacacggttgagctgaccatgcgcggccactgctatgacgccatcgtgggcctcgcgggctgcgacaaatctctgccggggatgatgatggcgatgctgcggttgaacgtgccgtcggtcttcctctatggcgggtcaatcctgccgggcaaagcacctgccggggccgatgtgcccgaggatttcgccagccgcgatctgaccgtgcaggacatgttcgaagcggtgggccggttccagaacggcaccatgtcgcaagcagccctcgacgtgcttgagcgcgtggcttgcccatcggcgggcgcttgtggcggccagttcaccgccaatacaatggcctgcgtctccgaggcgatcggcctcgcgctgcccaactcgtccggcatgcccgcgccctatgagagccgcgacgcctatgccgaggcctctggcgcggcggtgatgaacctgatcgaaaagaacatccgcgcccgcgacatctgcacccgcgaagcctttgaaaacgcagcgcgcatcgtggcctgcaccggcggctcgaccaacgcgggcctgcacctgcccgccatggcgcatgaagccgggatcgagttctacctcgaagacgtttgcgaaatcttccgcgacacaccctatttcgtcgatatgaaaccgggcggcgcttatgtggccaaagatctttacgatgcgggcggcgtgccggtggtgatgaatgagttgcgcaaagcgggcctcattcacgaagactgcatgactgccaccggctactccatgggcgaagtgctcgatcaggttacccgcgaagcagacggcaaggtgatccactcggtcgccaatccgatcagcaagaccggcggtgtcgtgggcctcaaaggcaacctcgcccccgaaggtgccatcgtgaaaatcgcgggcatgtctgacgaagacatcgtcttcaccggcccggcactggtgttcgaatgtgagcaagacgctttcgaagccgtgcaaaaccgcgcctattccgaaggcgacgttttcgtcatccgcaacgaaggccccgcaggcggccccggcatgcgcgagatgctggccaccaccgccgcgctttcgggtcaaggcatgggcaagaaggtggcgctgatcaccgatggccgcttctcgggtgcgacacgtggcttctgtgtgggtcacgttggccccgaagcggcgcatggcggaccgattgcgctgctgaaaaacggcgacatgatcacccttgatgcgatcaaaggttccatcagcgtcgacctgagcgatgatgagcttgccgagcgccgcaagggctgggctggcccgcgtgccacaaactaccaaagcggcgcgctgtggaaatacgccaaacttgtcggccctacctaccttggtgccgtgacacatccgggcgctcaggccgagacccatgattacatggacctctaa

SEQ ID NO: 94 - protein, 588 aa, Oceanibulbus indolifex
MSTTPRFDKSRLPSRHVTEGPARAPHRSYYYAMGMTEQEIHQPLVGVATCWNEAAPCNIALSRQAQAVKIGVHSEQGTPREFTTITVTDGIAMGHEGMRSSLASREAIADTVELTMRGHCYDAIVGLAGCDKSLPGMMMAMLRLNVPSVFLYGGSILPGKAPAGADVPEDFASRDLTVQDMFEAVGRFQNGTMSQAALDVLERVACPSAGACGGQFTANTMACVSEAIGLALPNSSGMPAPYESRDAYAEASGAAVMNLIEKNIRARDICTREAFENAARIVACTGGSTNAGLHLPAMAHEAGIEFYLEDVCEIFRDTPYFVDMKPGGAYVAKDLYDAGGVPVVMNELRKAGLIHEDCMTATGYSMGEVLDQVTREADGKVIHSVANPISKTGGVVGLKGNLAPEGAIVKIAGMSDEDIVFTGPALVFECEQDAFEAVQNRAYSEGDVFVIRNEGPAGGPGMREMLATTAALSGQGMGKKVALITDGRFSGATRGFCVGHVGPEAAHGGPIALLKNGDMITLDAIKGSISVDLSDDELAERRKGWAGPRATNYQSGALWKYAKLVGPTYLGAVTHPGAQAETHDYMDL

SEQ ID NO: 95 - DNA, 1767 bp, Sulfitobacter sp.
atgtccaccaacacccgctttgataaatccagactgccaagccggcacgtgaccgaggggccagagcgcgcaccgcaccggtcctattactacgcaatgggcatgaccgaagaagagattcaccagcctctggtgggtgtggcaacctgctggaacgaagcggccccctgtaacatcgcgctgaaccgtcaggcccaagcggtcaaggtcggcgtcaaggcgcagcaaggcacgccacgcgaattcaccaccatcactgtcaccgacgggatcgccatgggccacgagggcatgcgctcttccctagcgtcgcgcgaagcgattgccgacacggtagagctgacaatgcgcggtcactgctacgatgcgattgtcggtcttgcgggctgtgacaaatcgctgccgggcatgatgatggcgatgctgcggctgaacgtgccgtccgtgttcctctacggtgggtcgatcctgccgggcaaagtcccggaaggggccgatgtgcctgccgatttcgccagccgcgatctgactgtgcaagacgttttcgaagccgtgggtaactaccagaacggcagcatgtcgcaagccgcgcttgaagtattggagcgcgtcgcttgcccgacagccggtgcctgcgggggccagttcaccgccaacactatggcctgcgtgtccgaggcaattggtctggcgctgctgaactcctctggcatgcctgcgccctatgaatcccgcgacgcctatgcggcggcctcgggtgaagccgtcatgaacctgatcgaaaagaacatccgcgcgcgcgacatctgcacccgcgaagcgttcgagaatgcggcgcgtatcgtggcctgcaccggcgggtcgaccaatgccggtctgcacctgcccgctatggccgccgaggcgggtatcgactttaacctcagcgatgtgtgcgacatcttccgcgacacgccttatttcgtcgacatgaaacccggcgggtcgcatgtggcaaaagacctgtatgacgcgggcggcgtgcctgttgtgatgaaagaactgcgcaaggctggcctgctgcatgatgactgtctcaccgcctcgggcctgtccatcggtgaagagctcgacaagatcgaacgcgaagccgacggcaaggtgatccacgcgatcgaaacaccgatcagcaagaccggcggcgtcgttggtctgaagggcaacttggcacccgaaggggccatcgtgaaaatcgcgggcatgtccgaagaagacatcgtctttaccggtccggcgctgatctttgaatgtgaacaggatgcgttcgaagccgtgcaaaaccgggcctacagcgaaggcgacgtgttcgtgatccgcaacgaaggccccgctggtggccccggcatgcgcgaaatgctggcgaccacggcggccctgtccggtcaaggcatgggcaaaaaggtggcactgatcaccgacggccgtttctccggcgcgacacggggtttctgcgttggtcacgtcggccccgaagccgcacatggcggaccgattgccttgctcaaacagggtgacatgatcacactgaacgcgatcaccggttcgatctctgtcgatatctcggacgaggaaatggcagaacgcaaagcggcttggcccggtgcccgcaaaacaaactatcaaagcggtgcactgtggaaatacgcgcagcttgtgggcccaacctatcttggtgcggtgacgcatcccggcgcgaaggcggaaacacatgactatatggacctgtaa

SEQ ID NO: 96 - protein, 588 aa, Sulfitobacter sp.
MSTNTRFDKSRLPSRHVTEGPERAPHRSYYYAMGMTEEEIHQPLVGVATCWNEAAPCNIALNRQAQAVKVGVKAQQGTPREFTTITVTDGIAMGHEGMRSSLASREAIADTVELTMRGHCYDAIVGLAGCDKSLPGMMMAMLRLNVPSVFLYGGSILPGKVPEGADVPADFASRDLTVQDVFEAVGNYQNGSMSQAALEVLERVACPTAGACGGQFTANTMACVSEAIGLALLNSSGMPAPYESRDAYAAASGEAVMNLIEKNIRARDICTREAFENAARIVACTGGSTNAGLHLPAMAAEAGIDFNLSDVCDIFRDTPYFVDMKPGGSHVAKDLYDAGGVPVVMKELRKAGLLHDDCLTASGLSIGEELDKIEREADGKVIHAIETPISKTGGVVGLKGNLAPEGAIVKIAGMSEEDIVFTGPALIFECEQDAFEAVQNRAYSEGDVFVIRNEGPAGGPGMREMLATTAALSGQGMGKKVALITDGRFSGATRGFCVGHVGPEAAHGGPIALLKQGDMITLNAITGSISVDISDEEMAERKAAWPGARKTNYQSGALWKYAQLVGPTYLGAVTHPGAKAETHDYMDL

SEQ ID NO: 97 - DNA, 1764 bp, Roseobacter denitrificans
atgtccagccagcgctttgataaatccaagctgcccagccgccatgtgaccgagggaccctcacgggcgccgcatcggtcctactattacgcgatgggcatgacggaggaagaaatccatcaaccgcttgttggcgtggccacttgctggaacgaggccgccccctgcaacatcgcgctgaaccgccaggcgcaatcggtcaagatgggcgtgaaacgcgaaagcggcacgccacgtgaattcaccaccatcaccgtcaccgacggcatcgcgatgggccacgagggcatgcggtcgtcactggcgtcacgcgaggcaattgccgatacggtggaactgaccatgcgcgggcattgctatgacgcacttgtggggctggcgggctgcgacaaatccctgccgggcatgatgatggcgatgatccgtctgaatgtgccatcggttttcctttatggcgggtcaatcctgccgggacgtgcgcccaagggggcgtcggtgcctgccgaatacgccgaccgcgacctgaccgttcaggacatgttcgaagctgttgggcatcaacagaacggcaccctgagcgaggcagaactcgaagtgctcgaacgcgtcgcctgcccttctgccggggcttgtggcgggcagtttaccgccaacaccatggcctgtgtatccgaggccatcggtctggcgttgcccaattccgccggggcacctgcgccgtacgaatcccgcgacgcctatgccgaagcctcgggtgcggcggtcatgaacctgatcgaaaagaacatccgtgcgcgcgacatctgcacgcgggaggccttcgagaatgccgcgcgcatcgtcgcttgtacgggcgggtcgaccaacgccggtctgcacctgcctgccatggcgcatgaagcgggcatcgatttcttcctcgaagacgtctgcgagatcttccgcgacacgccctatttcgtcgatctgaaaccgggcgggcagtatgtcgccaaggacatgtacgaagccggcggcgtgcccgtggtaatgaaagagctgcgcaaggcaggcctgttgcacgaggactgcatgaccgtcaccggctattccatcggcgaggaactggacaaggtcagccttgaggcggatggccgagttgtctatccgattgaaacaccgctgtcgaaaaccggtggcgtcgtcggcctcaagggcaaccttgcccccgaaggagccatcgtgaaaatcgccggaatggagccgcagcatttgctgttcaccggccctgcgcgaatctttgagtgtgagcaggacgcgtttgaagccgtccagaaccgcacctacaaagagggcgatgtctttgtcatccgcaacgagggccctgctggcggccccggcatgcgcgagatgctggcaacgacggcggcgctttcgggtcagggcatgggcaagaaagtcgcgctgatcacggatggacgtttctcgggggcgacacgcgggttctgcgtcggccatgtgggtcccgaggccgcgcacggaggccccatcgccttgctcaaggatggcgatatgatcacgcttaacgcgatcgaggggaccatcaccgtcgatgtgtccgacgaggagatggccgagcgtaaagccaattggaaaggggcgcgtccaacgatctatggtgctggtgccttgtggaaatacgcgcaacttgtggggccaacctatctcggggccgtgacccatccgggcggtaaagacgaaggccacgcgtacatggaactgtaa

SEQ ID NO: 98 - protein, 587 aa, Roseobacter denitrificans
MSSQRFDKSKLPSRHVTEGPSRAPHRSYYYAMGMTEEEIHQPLVGVATCWNEAAPCNIALNRQAQSVKMGVKRESGTPREFTTITVTDGIAMGHEGMRSSLASREAIADTVELTMRGHCYDALVGLAGCDKSLPGMMMAMIRLNVPSVFLYGGSILPGRAPKGASVPAEYADRDLTVQDMFEAVGHQQNGTLSEAELEVLERVACPSAGACGGQFTANTMACVSEAIGLALPNSAGAPAPYESRDAYAEASGAAVMNLIEKNIRARDICTREAFENAARIVACTGGSTNAGLHLPAMAHEAGIDFFLEDVCEIFRDTPYFVDLKPGGQYVAKDMYEAGGVPVVMKELRKAGLLHEDCMTVTGYSIGEELDKVSLEADGRVVYPIETPLSKTGGVVGLKGNLAPEGAIVKIAGMEPQHLLFTGPARIFECEQDAFEAVQNRTYKEGDVFVIRNEGPAGGPGMREMLATTAALSGQGMGKKVALITDGRFSGATRGFCVGHVGPEAAHGGPIALLKDGDMITLNAIEGTITVDVSDEEMAERKANWKGARPTIYGAGALWKYAQLVGPTYLGAVTHPGGKDEGHAYMEL

SEQ ID NO: 99 - DNA, 1764 bp, Jannaschia sp.
atgaccgccaacaggccagacaaatccagattgcccagtcgccatgtgaccgaaggacccgagcgcgcgccgcatcggtcgtatttctacgccatggacctgacacaggagcagatcgaccagccattcgtcggcgtcgccacctgctggaacgaagcggccccttgcaacatcgcgctcaactggcaggcgcaatcggtgaaacgcggtgtgggtgaggcgaacggtacgccgagggaattcaccacgatcaccgtcaccgacggcattgcgatggggcatgaagggatgcggtcctcgctggcgtcgcgcgatgcgatcaccgacacggtggaactgacgatgcgcggccactgctatgacgcattggtcgggcttgccgggtgcgacaagtccctgcccggcatgatgatggccatggtgcgcctgaacgtgccgtccgtcttcatctatggcggcacgatccttcccggcaaagcgcctgaagttgccgacattcccgccgagtttgccaaccgtgacctgaccgtgcaggacatgttcgaggccgtgggcaagtaccagtccggccaattgagcgaagccgccctggaagttctggaacgcgttgcctgcccgtctgcgggcgcctgtggcggtcagttcaccgccaacaccatggcatgtgtgtccgaggcgattggtctggcaatgctcaactcctccgggatgcctgcgccttacgaggggcggaaggaattcggcgaggcaagcggtcgcgcggtgatgaacctgcttgaaaagaacatccgcgcccgtgacgtcgtcacccgcaaagcgttggagaatgcggcccgtgttgtggcgtgtaccgggggctccaccaatgcaggtctgcaccttcccgcgattgcccatgaggccggaatcgacttcgacctctttgacgtctgcgacatcttcaaggacacgccctacttcgtcgacatgaaacccggcggtcagtatgtggcgaaagacctctatgaggtgggcggcgtgccagtcgtgatgaaggagctgttgaaagaggggctgttgcacggcgattgcctcactgcctctggcgagacgatggaagaggcgctcgacaagatccagggcacgcccgatggccgtgtggtccatacggtccagaacccgatcaccagcaccggcggcgtggtcggcctgcgcggcaatctcgccgaagagggtgcgatcgtgaaagttgcgggcatggatgaggcaagccaggtcttcaccggacccgcgcgcgtgtttgaatgcgaagaagacgcctttgccgccgtgaaggcgcgcggctacgaggaaggcgaagtcattgtcatccgcaatgaagggccaaagggcggcccgggcatgcgggaaatgttggcgacgacggcggcattgtcgggtcagggcatgggcaagaaggtggccctgatcaccgacggccggttctctggtgcaacgcggggcttctgcgtcggtcacgtgggacctgaggcggctgttggcggaccgattggtctgctggagaacagcgacatgatcaccatcaatgcgctgacgggggaactgtcggttgccttgaccgaggcggaattggccgagcgtcggaaggcctgggccggtccgcgtgagacaatgtacgcctctggcgcgttgtggaaatacgcgcaattggtgggagaggcgcgctatggcgcggtgacccatcccggcggggccaaggaaaagcacgtctatgcggacatctag

SEQ ID NO: 100 - protein, 587 aa, Jannaschia sp.
MTANRPDKSRLPSRHVTEGPERAPHRSYFYAMDLTQEQIDQPFVGVATCWNEAAPCNIALNWQAQSVKRGVGEANGTPREFTTITVTDGIAMGHEGMRSSLASRDAITDTVELTMRGHCYDALVGLAGCDKSLPGMMMAMVRLNVPSVFIYGGTILPGKAPEVADIPAEFANRDLTVQDMFEAVGKYQSGQLSEAALEVLERVACPSAGACGGQFTANTMACVSEAIGLAMLNSSGMPAPYEGRKEFGEASGRAVMNLLEKNIRARDVVTRKALENAARVVACTGGSTNAGLHLPAIAHEAGIDFDLFDVCDIFKDTPYFVDMKPGGQYVAKDLYEVGGVPVVMKELLKEGLLHGDCLTASGETMEEALDKIQGTPDGRVVHTVQNPITSTGGVVGLRGNLAEEGAIVKVAGMDEASQVFTGPARVFECEEDAFAAVKARGYEEGEVIVIRNEGPKGGPGMREMLATTAALSGQGMGKKVALITDGRFSGATRGFCVGHVGPEAAVGGPIGLLENSDMITINALTGELSVALTEAELAERRKAWAGPRETMYASGALWKYAQLVGEARYGAVTHPGGAKEKHVYADI

SEQ ID NO: 101 - DNA, 1731 bp, Caulobacter sp.
atgaccaagaaacccgacgggacctgggacaagtcgcaactgcccagccggcatgtaaccgaagggccggcccgcgcgccgcaccgctcttattattacgccatgggtcttggcacgcgtgagatcgcccagccgttcgtcggcgtcgcctcgtgctggaacgaggccgcgccctgcaacaccgccctgatgcgccaggccaacgccgtggccaagggcgtcaaggcggccggcggcaccccgcgcgagttctgcaccatcaccgtcaccgacggcatcgccatgggccacgagggcatgcgttcgtccctggtcagccgcgacgtgatcgccgactccgtcgagctgaccatgcgcggccacggctatgacgcgctcgtgggcgtcgccgggtgcgacaagagcctgccgggcatgatgatggccatgctgcgcctcaacgtgcccagcgtgttcctgtacggcggctcgatcctcccgggacgcttccagggccgcgacatcaccgtgatggacgtcttcgagggcgtcggcgcctatgccgccgggaccatggacgccaagaccctgtgcgagctggagcagcacgcctgcccgtcggacggcgcctgcggcggccagttcacggccaacaccatggcctgcgtgtcggaagccatcggcctggccctgccgctgtcctcggccctgccggccccgtacctggaccgcgaccagtacgcggtggcctcgggcgaggcggtgatgcggctgatcgagcagaacatccgcccgcgcgatatctgcacccgcaaggccttcgagaacgccgccgtcgtcgtcgcggccaccggcggttcgaccaatggcgcgctgcacctgccggccatggcccacgagtgcggcatcgagttcaccctcaaggacgtggccgagatcgccgcccgcacgccctatatcgccgacctcaagcccggcggtcgctacgtggccaaggacatgggcgaggccggcggcgtgccgatgctgctgcgcaccctgctggacgccggcctgctgcacggcgacgtcatgaccgtcaccggcaagaccctggccgagaacctggccgatgtggtctggcgtgaggaccaggacgtgatccgcccggtctccaatccgctgtcgccgactggcggcgtggtcggcctgtggggctcgctggcgcccgagggcggcatcgtcaaggtggccggcctcaagcaccaggtgcaccgcggcccggcccgggtgttcgacggcgaggcggcctgtttcgaagcggtgtcgaaccgcgactacaaggcaggcgacgtcctggtcatccgctacgaaggtccgcgcggcgggccgggcatgcgcgagatgctgtcgacgaccgccgcgatctacggccagggcgtggagaacatcgccctgatcaccgacggccgcttctcgggcgccacgcgcggcctgtgcatcggccacgtgggtcccgaggccgccgtgggcggtccgatcgccctggtgcaggacggcgacatcatcagcatcgacgccaccaaggggacgatcgagcttgaggtcgaggccgaggaactggcgcgccgcaaggccgcctggaagccgcgcggccacgactacaacagcggcgcgatctggaagttcgcccaactggtcggtccagcctatcttggcgccacgacccatccgggcgcggccaaggagacgcacgtctacgcggacatctga

SEQ ID NO: 102 - protein, 576 aa, Caulobacter sp.
MTKKPDGTWDKSQLPSRHVTEGPARAPHRSYYYAMGLGTREIAQPFVGVASCWNEAAPCNTALMRQANAVAKGVKAAGGTPREFCTITVTDGIAMGHEGMRSSLVSRDVIADSVELTMRGHGYDALVGVAGCDKSLPGMMMAMLRLNVPSVFLYGGSILPGRFQGRDITVMDVFEGVGAYAAGTMDAKTLCELEQHACPSDGACGGQFTANTMACVSEAIGLALPLSSALPAPYLDRDQYAVASGEAVMRLIEQNIRPRDICTRKAFENAAVVVAATGGSTNGALHLPAMAHECGIEFTLKDVAEIAARTPYIADLKPGGRYVAKDMGEAGGVPMLLRTLLDAGLLHGDVMTVTGKTLAENLADVVWREDQDVIRPVSNPLSPTGGVVGLWGSLAPEGGIVKVAGLKHQVHRGPARVFDGEAACFEAVSNRDYKAGDVLVIRYEGPRGGPGMREMLSTTAAIYGQGVENIALITDGRFSGATRGLCIGHVGPEAAVGGPIALVQDGDIISIDATKGTIELEVEAEELARRKAAWKPRGHDYNSGAIWKFAQLVGPAYLGATTHPGAAKETHVYADI

SEQ ID NO: 103 - DNA, 1719 bp, Candidatus Pelagibacter ubique
atggcaaaatttaataaaaaaaaattaccaagcagacatacttcattaggtgctgatagagctccacatagatcattttactatgcaatgggtgaaacagaaaaagatgtagcaaagccatttgttggtgttgtgtcaacttggaatgaagctgctccttgtaatattgctttaatgagacaagctcaatctgtcaaaaaaggcgttagagcttcaggtggaacccctagagaattttgtacgataacagtaactgatggtattgccatgggtcacgaaggaatgaagtcatctttaatctctcgcgaggtaattgctgattcaactgaacttactgtgcgtggtcattgttatgatgcgcttgttggtattgctggttgtgataaatctttacctgccttaatgatggcaatggttagattaaatgttccaagtgtatttatttatggtggctcaatacttccaggtcaatataaaggtaaagatgtaactgttgttgatgtttttgaagcagttggaaaacactcagctggaaaaatgtctgcaaaggaattaagaaaattagagttagttgcttgcccaagtgcaggtgcatgtggaggtcaatttactgcaaatactatggcctgcgtttctgaagctattggtttagcattaccttattcagctggaacacctgctccatacgaagaacgtgataagtatgcattattaagtggcaagactgtaatgaatttattacaaaaaaatattcgtccaagagacattgttacaaaaaaatctttagaaaatgctgcaacaattgtagcggctactggtggatcgacaaatgctgctttacacctaccagctatagctaatgaaattggaattaagtttgatttaatggatgtagctaaaatttttaaaaaaactccatatcttgcagatttaaaaccaggtggaaaatatgttgcaaaagatatgtggttagctggtggagtacctatgttattaaaaactctttttgatggtggttttatacatggtgattgcatgactgttactggaaaaacaatgaaacaaaatttaaaaaatattaaatttaatcctaagcaaaaagtattaagagcatatgataatcctttatcaccagatggcggtgttgtaggtcttaaaggtaacttagctcctgatggtggaattgttaaaattgctggtttaaaaaaattacaattcactggaaaagctagatgttttgataatgaagaagcagcaatggcttgtgtgcaaaagaaaaaatataaagcaggtgatgtaattattattcgttacgaaggaccagttggcggtcctggtatgagagaaatgctttcaacaacaggtgctatttatggtcaaggtatgggtgagaaggttgctctaattacagatggtagattttctggggctacaagaggtttttgtgtgggtcatgttggccctgaggcggccttaggcggccctttagctcttttacgcaatggagatgtaattgatatagatgccaaaaaagggactattaacgttagattaactaaatcacaattagccacaagacataagaagtggaaagcaaaaaaatcaagctttggatcgggtactatttggaaatatgctcaaacagtaggtcccgcttatttaggtgcaccaacacatcccggtaaaagaaaagaagtaaaagtttacgctgatatttaa

SEQ ID NO: 104 - protein, 572 aa, Candidatus Pelagibacter ubique
MAKFNKKKLPSRHTSLGADRAPHRSFYYAMGETEKDVAKPFVGVVSTWNEAAPCNIALMRQAQSVKKGVRASGGTPREFCTITVTDGIAMGHEGMKSSLISREVIADSTELTVRGHCYDALVGIAGCDKSLPALMMAMVRLNVPSVFIYGGSILPGQYKGKDVTVVDVFEAVGKHSAGKMSAKELRKLELVACPSAGACGGQFTANTMACVSEAIGLALPYSAGTPAPYEERDKYALLSGKTVMNLLQKNIRPRDIVTKKSLENAATIVAATGGSTNAALHLPAIANEIGIKFDLMDVAKIFKKTPYLADLKPGGKYVAKDMWLAGGVPMLLKTLFDGGFIHGDCMTVTGKTMKQNLKNIKFNPKQKVLRAYDNPLSPDGGVVGLKGNLAPDGGIVKIAGLKKLQFTGKARCFDNEEAAMACVQKKKYKAGDVIIIRYEGPVGGPGMREMLSTTGAIYGQGMGEKVALITDGRFSGATRGFCVGHVGPEAALGGPLALLRNGDVIDIDAKKGTINVRLTKSQLATRHKKWKAKKSSFGSGTIWKYAQTVGPAYLGAPTHPGKRKEVKVYADI

SEQ ID NO: 105 - DNA, 1722 bp, Erythrobacter litoralis
atgtcgtcgagattcgacaagtccaagctgcccagccgccacgtttcggtcgggccagagcgcgcgccgcatcgttcgtattactacgcgatgggtctgaccgagcaggagatcgcgcgacccttcgtcggcattgttagcgcgggcaacgacagcgcgccctgcaacacgacgctcgatgcgcaggcggacatctgtcgcactggcgtcaaccaagcaggcggcatgccgcggcgcttcaacaccatcaccgtgacggacggtatcgccatgggacaccagggcatgaaaagctcgctggtcagccgcgaggtgattgcggactcgatcgagctatcggtgcgcgggcattgctatgatgcgctggtcggattcgccggctgcgacaagagcttgcccggcatgatgatggccatgctgcggctcaatgttccgagcatcttcgtctatggcggatcgatcctgccgggccgcttccacgacaaggacgtgaccgtcgtcgacgtgttcgaagcggtcggccagcacgcggcgggcaattgtccgctgaaagaactgaccgcgctggaaaaggtcgcctgtcccgggcacggcgcgtgcggcgggcagtttaccgccaacaccatggcctgcgtcggcgaagcgatcggcctgtcgctgcccaacagcaatatggcccccgcgccctatcgttcgcgcgaggagatcgcggtggcggcggggcggcaggtcatgacgctgctggagaaaaacctgcgcccgcgtgacatctgcacaagggccgcattcgagaatgcagcacgggtcgtcgcggcaacgggcggctcgaccaatgccgctttgcacctgcctgccatggcccatgaatgcggcatcgacttcgacctgttcgatgtcgccgagacattcaaatcaacaccttatatcgcagacctcaaacctggcgggcgctatgtcgccaaggacatgcacgaggcgggcggggtctacatggcgatgaaaacgctgctggagggcggtttcctcgatcccgaaccgatgaccgtcacaggcaagacgctgggcgagaatatcgaggagatcacctgggaccccgaccagaaggttttctacgacgtatccaatccgatcacgccgaccggcggcgtcgtcgggctcaggggttctctcgcgcccgacggggcgattgtgaaggtggcgggaatggaacggctccagttcagcggcccagcgcgagtattcgattgcgaggaggatgccttcaaggcggtcgagcagcgcgacatcgccgaaggttgcgtcatcgtaatccgctacgaaggccccaagggcggccccggcatgcgcgaaatgctctctactaccgcagcgctctacgggcagggcatgggcgagaaagtggcgctcatcaccgacgggcgcttctccggcgcgacgcgcggcttttgcatcggccatgtcggcccggaagcggcagactgcggcccgattgcgctggtcgaggatggcgatacaatcagcatcgatgccgttgcaggcacgattgagctcgacgtcgatgccgaaacgcttgaaaaacggcgtcaaagctggacaccgcgggcgaacgattaccagtccggcgcgctgtggcgctatgcgaggaacgtcggtcctgcgcatgagggcgcagtgactcatccgggagcgaaatcggaacgccatgtctttgcggatatctag

SEQ ID NO: 106 - protein, 573 aa, Erythrobacter litoralis
MSSRFDKSKLPSRHVSVGPERAPHRSYYYAMGLTEQEIARPFVGIVSAGNDSAPCNTTLDAQADICRTGVNQAGGMPRRFNTITVTDGIAMGHQGMKSSLVSREVIADSIELSVRGHCYDALVGFAGCDKSLPGMMMAMLRLNVPSIFVYGGSILPGRFHDKDVTVVDVFEAVGQHAAGNCPLKELTALEKVACPGHGACGGQFTANTMACVGEAIGLSLPNSNMAPAPYRSREEIAVAAGRQVMTLLEKNLRPRDICTRAAFENAARVVAATGGSTNAALHLPAMAHECGIDFDLFDVAETFKSTPYIADLKPGGRYVAKDMHEAGGVYMAMKTLLEGGFLDPEPMTVTGKTLGENIEEITWDPDQKVFYDVSNPITPTGGVVGLRGSLAPDGAIVKVAGMERLQFSGPARVFDCEEDAFKAVEQRDIAEGCVIVIRYEGPKGGPGMREMLSTTAALYGQGMGEKVALITDGRFSGATRGFCIGHVGPEAADCGPIALVEDGDTISIDAVAGTIELDVDAETLEKRRQSWTPRANDYQSGALWRYARNVGPAHEGAVTHPGAKSERHVFADI

SEQ ID NO: 107 - DNA, 1716 bp, Erythrobacter sp.
atgtccttcgataagtccaagttgccaagccgccatgtctcggtcgggcctgaacgcgcgccccaccgttcctactattacgcgatgggcatgaccgaggaagaaatcgcacgccccttcgtcgctgtggccagtgctggtaacgattccgcgccgtgcaacacaacgctcgatccgcaggcgaatatctgtcgcgaaggcgtcattgcggggggagggaccccgcgccgcttcaacaccatcacggttacggacgggatcgcgatgggccatcagggcatgaagagctcgctggtaagtcgcgaggtcattgcggactccgtcgagctttcggtgcgcggtcattgttacgatgcgcttgtaggatttgccggatgcgacaaaagcctgcccgggatgatgatggccatgctgcggctgaacgtgccgagcatctttgtctatggcggctcgatcctcccaggcactcatcgcggcaaggacgtgacggtcgtcgatgtgttcgaagccgtgggccagcatgctgccgggaattgcccgcttcaggagttgatcgagctcgaaaaggttgcctgtcccggacacggagcctgtggcggccagttcacagccaatacgatggcctgcgtgggtgaggcaatcggattgtcattgccgaacagcaacatggctcctgctccttacagatcgcgtgaagaaatcgctcgcgccgcgggcgagcaggtgatgatactgcttaagcaaaatctgcgcccacgcgacatctgcacgcgcgcggcctttgaaaacgcggcccgcgttgtcgccgcaaccggcggttctaccaatgccgctctgcaccttcctgccatggcgagcgaatgcgggattgatttcgatcttttcgacgttgcggagatcttcaaatcgacaccctacatcgccgacctgaagcccggcggtaagtacgtcgcaaaggacatgcacgaagcgggcggcgtctacatgggcatgaagacactgctcgaaggagggttcctcgatcccgggccgatgactgtgaccggcaagacgctgggcgagaacatcgaggagatcacctggaaccccgatcaaaaggtattctacgacgtaaagaacccgatcaccccgaccggcggtgtggttgggcttaagggctcgctcgcgcccgaaggtgcgatcgtaaaggttgccgggatggaacgtttgcaattcaccggcacggctcgcgtattcgaatgcgaggaagatgccttcgaggcggtcgagaagcgcgacattgtcgaaggcagcgtcatcgtcatccgctacgaaggccccaagggtggacctggaatgcgcgagatgctcgccaccaccgctgcgctttacggccagggtatgggtgagaaagtcgccctcatcacagatgggcggttctcaggcgctacgcgtggtttctgtatcggccatgtcggccctgaagccgcggatggcggaccgatcgctctcgtcgaggatggcgacacgatcagcatcgatgccgagcttggcacgatcgacctggaggtcgaccaaagcgtgcttgaagaacgccgaaaagcatggaagccgcgtacgaacgattatcagtcgggggcgctgtggcgttacgcgcagaatgtcgggtccgcacgaaacggagcgctcactcacccgggcgccaagtctgagacccatgtgtttgcggacatctag

SEQ ID NO: 108 - protein, 571 aa, Erythrobacter sp.
MSFDKSKLPSRHVSVGPERAPHRSYYYAMGMTEEEIARPFVAVASAGNDSAPCNTTLDPQANICREGVIAGGGTPRRFNTITVTDGIAMGHQGMKSSLVSREVIADSVELSVRGHCYDALVGFAGCDKSLPGMMMAMLRLNVPSIFVYGGSILPGTHRGKDVTVVDVFEAVGQHAAGNCPLQELIELEKVACPGHGACGGQFTANTMACVGEAIGLSLPNSNMAPAPYRSREEIARAAGEQVMILLKQNLRPRDICTRAAFENAARVVAATGGSTNAALHLPAMASECGIDFDLFDVAEIFKSTPYIADLKPGGKYVAKDMHEAGGVYMGMKTLLEGGFLDPGPMTVTGKTLGENIEEITWNPDQKVFYDVKNPITPTGGVVGLKGSLAPEGAIVKVAGMERLQFTGTARVFECEEDAFEAVEKRDIVEGSVIVIRYEGPKGGPGMREMLATTAALYGQGMGEKVALITDGRFSGATRGFCIGHVGPEAADGGPIALVEDGDTISIDAELGTIDLEVDQSVLEERRKAWKPRTNDYQSGALWRYAQNVGSARNGALTHPGAKSETHVFADI

SEQ ID NO: 109 - DNA, 1815 bp, Comamonas testosteroni
atgaacgattcccgctccaccgatccccaggccgctgtcagcggccacgctgaaccctccgactcctctgtgtcatcctccgccccgggcctgcgctcggccatcgtgcaccgcggcaccttgcgcgccagcgcgcgcagctttctgcatgcgctgggccaggacgatgaggagattgcacgcccgcatgtgggcgtgttccatacgggcggggagatgagcccctgcaatatgaatctccgcgaccaggcccagcatgccaagaccggcatctacgcgggaggcggcatgccgcacgagtgccccgtggtctcggtcagcgacggcctgaccatggcgcattcgggcatgcgcttttcgctgatctcgcgcgagctcatcgccgacagcgtggaggcctcggtgcgcggccaccagtgggacggtatctttgccgtgggtgcctgcgacaagaacctgccgggcctgatgatggccatggtgcgctgcaatgtgcccagcgtcttcgtgcatggcggctcggccctgcccgggcagatgccgggcagcgtatcggggcgcgcccttaacgtggtcgacacctacgagaccataggcaaggtgctggccggcacttccaccatgcaggagctggacaccgtcacgcgctcctgcctgccctcggccggggcctgtgccgggcagttcacggccaacaccatgggcatggtcagcgaggccctgggcctggcgcccataggctccagcatggtgccggccgtgttcagcgaacgcgcgccgctgatgcgccgcgcgggccgtcagctcatggaaatggtgtgggccagcgccaggggagaggccgtgctgccgcgcgacatcgtcacgcgcaaggccctggaaaatgcctgtgccgtggtctgcgccacgggtggctccacgaatgcggccctgcacctgccggcgatcgcgcacgaggccggcatacgctttcacctcgacgacgtggccgagatctttgcgcgcacgccgctgatcgcagacctcaagcccggcggccgcttcctggcacgtgatgtctactacatcggcggtgcggctgtcatcctgcgcaccctgctggagcagggcctgctgcatggcgatgcactcaccttcacgggccgcacgctggccgaggaggtggccgatgctgccgagcccgacggcgaagtggtgcgcaaggccggcaacccgatctcggccgacggtgggctcacggtgctcaagggcaatctgtgccctgacggtgccctgctcaagacggcggggctcaagaccctggtgcaccgcggtccggcccgcgtcttcgactccgaggaacaggcgcaggacgccgtgcaggccatggcctaccggagcggcgatgtgctggtgatacgcaacgaaggccccaagggcagccccggcatgcgcgagatgctgggcatcactgccttgctctatggccagggcatgggcgacaaggtggcactgctcaccgacgggcgcttctcgggcgccacgcgcggcctgtgcataggctacgcggggccggaggccgctgacggtgggccgattgccgcactgcaggacggcgacatcatcgccatcgatgcgcgggccggcgcgcgcagcatcacggtggagctggagcccgccgtcattgccgcgcggctggaagccgcccgggccagccgtgcgcagcagcgccccctgggcgggctgctggagaaatacgcgctgaccgtgcgtcccgcccaccagggcgcggtcacgcattcgggggcggtgacctggctgcgcgacagcaagtga

SEQ ID NO: 110 - protein, 604 aa, Comamonas testosteroni
MNDSRSTDPQAAVSGHAEPSDSSVSSSAPGLRSAIVHRGTLRASARSFLHALGQDDEEIARPHVGVFHTGGEMSPCNMNLRDQAQHAKTGIYAGGGMPHECPVVSVSDGLTMAHSGMRFSLISRELIADSVEASVRGHQWDGIFAVGACDKNLPGLMMAMVRCNVPSVFVHGGSALPGQMPGSVSGRALNVVDTYETIGKVLAGTSTMQELDTVTRSCLPSAGACAGQFTANTMGMVSEALGLAPIGSSMVPAVFSERAPLMRRAGRQLMEMVWASARGEAVLPRDIVTRKALENACAVVCATGGSTNAALHLPAIAHEAGIRFHLDDVAEIFARTPLIADLKPGGRFLARDVYYIGGAAVILRTLLEQGLLHGDALTFTGRTLAEEVADAAEPDGEVVRKAGNPISADGGLTVLKGNLCPDGALLKTAGLKTLVHRGPARVFDSEEQAQDAVQAMAYRSGDVLVIRNEGPKGSPGMREMLGITALLYGQGMGDKVALLTDGRFSGATRGLCIGYAGPEAADGGPIAALQDGDIIAIDARAGARSITVELEPAVIAARLEAARASRAQQRPLGGLLEKYALTVRPAHQGAVTHSGAVTWLRDSK

SEQ ID NO: 111 - DNA, 1707 bp, Sphingomonas wittichii
atgacgacccgaaaatttcgatccgagatcatccgcgaaggcgtggtccgaacgaccacgcgcagcttcctctacgccctgggcgaggacgacgaggatctgcggcagcctcatgtcgccgtcatccacaccggcggcgagatgagcccgtgcaacaccacgctgcgcgatcaggcgctccacgccaagacgggcatctatgcgggtggcggcacggcgcatgaatgcccggtggtgtcggtgtcggacgggctgtcggtggcgcattcggggatgcgcttctcgctgatctcgcgcgagctgatcgccgacagcgtggaggcgaccgtccggagccatcaatgggatggcgtcctcgcggtcggcggctgcgacaagaacatgcccggcctgatgatgggcatcgtgcgctgcaacgtcccctcggtcttcctctatggtggggcagccctgcccggccatctcggcggccgcgacgtcaacatcgtcgacacctatgagatgatcggccgggtcctggcgggagaggcgacgcaaggggaactggaggacatggcccgcgcctgtcttccgacggcgggagcctgtgccggccaatataccgccaacaccatgggcatggtgtcggaagcgctcggcctggcgctgctgggctcctcgatgatcccggcggtctatgccgcccgggcgccgatggcgcgcaaggcgggcaaggtgctgatgcgagcggtgctcggcggtgggccgctgccgcgcgacatcgtcacccgcaaggcgctggaaaatgcctgcgccgtggtcgccgccaccggcggttcgaccaacgcgccgctgcaccttcccgcgatcgccaacgaagcggggatcgatttcgacctcgacgatgtcgccgcagtgctcgcccgcacgccgctgatcgccgatctcaagcccggcggccgcttcctggccaaggacgtgttcgagatcggcggcaccccggtgatcctgaaggccctgctcgacggcggccatctccatggcgactgcatgacggtcaccgggcggacgctcgccgaagacctcgccaaggtctgcccgccggacggggcggtggtccgcgactgcggcatgccgatcgcgccgtccggcggcgtgaccgtgctcaagggcaatctggccccagacggcgcactgctgaagaccgccggcctgaagaagctcgagcatcgcggccccgcccgcgtcttcgagtccgaggagcaatgcctctccgccgtgcgggcgatggcctatgcggccggcgacgtcatcgtgatccgcaacgaagggccgcgcggcggccccggtatgcgcgagatgctgggcatcaccgcgctgctctacggccagggcatgggggagaaagtcgccctgatcacggacggccgcttctcgggcgcgacccggggcatgtgcatcggctatatctcgcccgaagcggccagtgatggaccgatcggcctggtccgcgacggtgatctcatcgccatcgacgcgcgcgacggcatcgtcagtttgcaggtcgaactgccaaaaggtgagttggaggcgcgtcgcgccctgccccgccccgcccgtgttcgtccgaaaggaggggtcctcgaaaaatatgcggcgatcgttggaccggccaacaagggcgccgtaacccatagcggcaacgtcatatgggagatggatccgtga

SEQ ID NO: 112 - protein, 568 aa, Sphingomonas wittichii
MTTRKFRSEIIREGVVRTTTRSFLYALGEDDEDLRQPHVAVIHTGGEMSPCNTTLRDQALHAKTGIYAGGGTAHECPVVSVSDGLSVAHSGMRFSLISRELIADSVEATVRSHQWDGVLAVGGCDKNMPGLMMGIVRCNVPSVFLYGGAALPGHLGGRDVNIVDTYEMIGRVLAGEATQGELEDMARACLPTAGACAGQYTANTMGMVSEALGLALLGSSMIPAVYAARAPMARKAGKVLMRAVLGGGPLPRDIVTRKALENACAVVAATGGSTNAPLHLPAIANEAGIDFDLDDVAAVLARTPLIADLKPGGRFLAKDVFEIGGTPVILKALLDGGHLHGDCMTVTGRTLAEDLAKVCPPDGAVVRDCGMPIAPSGGVTVLKGNLAPDGALLKTAGLKKLEHRGPARVFESEEQCLSAVRAMAYAAGDVIVIRNEGPRGGPGMREMLGITALLYGQGMGEKVALITDGRFSGATRGMCIGYISPEAASDGPIGLVRDGDLIAIDARDGIVSLQVELPKGELEARRALPRPARVRPKGGVLEKYAAIVGPANKGAVTHSGNVIWEMDP

SEQ ID NO: 113 - DNA, 1767 bp, Burkholderia xenovorans
atgaccaatctgcataaacaccgctcccgcatggtgaccgatggtgtgacgcgtgcgccgcaccgtgcctttctgcgcgcgacaggcctcgacgatgcgtcgatgcaaaagccgttcgtcgcgatcgtcgatacgtttggcgagaacacgccgtgttcgatgtcgctgaaccaggtgtccgataacgcacgtctcggcgttgccgctggcggcggcataccgattcgcggctcggcgatctcggtgtcggacggtacctcgatgaatcattcggggatgcgcatgagccttgtatcgcgcgagatcgtcgcggacagcgtcgagctgttcgtgcgtgcccatgcctacgatgcgctgatcggcgtggccggctgcgacaagacgctgcccggcatcctgatgggcatggttcgcgtcaacgtgcccggcgcgttcctgttcggcggcgcgatgctgccgggcgtggcgcccgggcagatccccggcggaggcggcacgggccagcaacgccaggcaacgatcctcacgaccatcgaagcggtgggcaccgcgcagcgcggcgacatcacccgcgcgcagctcgacgccatcgaaaagcagtgcacgccgaccgccggctcatgtcccggccagttcaccgcgaacaccatggcgatggtcgcggaagcgctgggactcgccccgctcggctcggcgatggtgccggccgtctatagcgaacgcattgcgattgcgcggcgcgctggcgaaacggtgatgcgcacgctcaaggaaggcgccccgctgccacgcgatctggttacgctgaaaagcctggagaatgcctgcgccgccgttgccgcgacgggcggctcgaccaacgccgcgctgcacattccggcgatcgcgcatgaagccggcatccgcttcacgctcgacgacgtgcagcgcgtgttcgcgcgcattccgctgatcggcgacctgcagcccggcggccgctatctcgcgcaggacctgcatcatgcgggcggcgtgccggcggtgctcaacgcgttgctggccggtggctatctgcatggcgacgccctcacgctcgacggcctcacgctggaagacgcgttgcgcggctacgccggtcccgatggcacggtggtgcgttcatgcgatgaaccgctcggcgagaacggcggcctcgtgatcctgcgcggcaatctcgcaccggacggtgcgtgcctgaaaatcgccgggctcaaagcgctgaccttctcaggtaagacgcgcatcttcgaatgcgaggaagactgcatggcggtggtcgctgcacgcgattatcgcgaaggcgacgtcctcgtgatccgcaacgaagggccgaagggcggtcccggcatgcgggagatgctcagcgtgaccgcggcgatctacggacaaggcatgggcgagaaagtcgcgctgctgaccgatggacgcttttcgggggcgacgcgcggcatgtgtatcggttatgtcggaccggaagcggcggtgggcggtccgattgcgctgctgcgcgatggtgatcgggtgcagatcgatgcgcgcgcgggaacgctgcgcgtcgagctatccgacgacgaactcgcgcgacgccgtgcggatctgccggcgaggccaaggcgccggctcgccggcgtgctggagaagtacgaggcgctggtgcggcctgcgcatctcggggcggtcacgcattcgggcaatctcgattggccctacgatgcgccgacgcatggcgacgacggagccgccgcgtga

SEQ ID NO: 114 - protein, 588 aa, Burkholderia xenovorans
MTNLHKHRSRMVTDGVTRAPHRAFLRATGLDDASMQKPFVAIVDTFGENTPCSMSLNQVSDNARLGVAAGGGIPIRGSAISVSDGTSMNHSGMRMSLVSREIVADSVELFVRAHAYDALIGVAGCDKTLPGILMGMVRVNVPGAFLFGGAMLPGVAPGQIPGGGGTGQQRQATILTTIEAVGTAQRGDITRAQLDAIEKQCTPTAGSCPGQFTANTMAMVAEALGLAPLGSAMVPAVYSERIAIARRAGETVMRTLKEGAPLPRDLVTLKSLENACAAVAATGGSTNAALHIPAIAHEAGIRFTLDDVQRVFARIPLIGDLQPGGRYLAQDLHHAGGVPAVLNALLAGGYLHGDALTLDGLTLEDALRGYAGPDGTVVRSCDEPLGENGGLVILRGNLAPDGACLKIAGLKALTFSGKTRIFECEEDCMAVVAARDYREGDVLVIRNEGPKGGPGMREMLSVTAAIYGQGMGEKVALLTDGRFSGATRGMCIGYVGPEAAVGGPIALLRDGDRVQIDARAGTLRVELSDDELARRRADLPARPRRRLAGVLEKYEALVRPAHLGAVTHSGNLDWPYDAPTHGDDGAAA

SEQ ID NO: 115 - DNA, 1767 bp, Burkholderia phytofirmans
atgaccaatctgcacaaacatcgctcgcgcagggtgaccgacggcgtcacccgcgcgccgcatcgcgcgttccttcgcgctaccggcctcgacgacgaatccatgcaaaagccgttcgtcgcgatcgtcgatacgttcggcgagaacaccccgtgttcgatgtcgctgaaccaggtctccgacaacgtgcgcctcggcattgcagcgggcggtggcgtgccgatccgcggctcggcgatctcggtgtcggacggcacgtcgatgaatcactccggcatgaggatgagcctcgtgtcgcgcgaagtggtcgcggacagcgtcgaactgttcgtgcgtgcgcataactacgacgcactgatcggcgtcgccggttgcgacaagaccttgcccggcatcctgatgggcatggtgcgcgtcaacgtgcccggtgtgttcctgttcggcggcgcaatgctgcccggcgtcgcacccggtcagttgcccggcggcgccggcaccggcctgcaacgccagtcgacgattctcacgacaatcgaagcggtcggcaccacgcagcgtggcgacatgagccgcgcgcaacttgacgccatcgaaaaacaatgcacgccgactgccggatcgtgtcccggccagttcaccgcgaataccatggcgatggtcgcggaaacgcttggcctcgcgccgctgggctccgcgatggtgcccgccgtctacagcgaacggattgcgattgcgcgccgcgccggcgagacagtcatgcgtatcctgacgcaaggcgggcccttgccgcgcgatctcgttacgatggaaagcctggagaacgcctgcgcggcagttgccgcgaccggcggttcgaccaatgccgcgctgcacattccggccatcgcgaacgaggccggcattcgcttcgcgctggacgacgtgcaacgcgtgttcgcgaaaattccgctgatcggcgatctgcaaccaggcggccgctatctcgcgcaggatctgcatcacgcgggcggcgtgccggccgtgttgaacgcgctgctggcaggcggcttcctgcatggcgatgtgcccgcgttcggcggcggcacgctcgccgaagcattgagcgcgttcagcggaccggacggcatcgtcgtgcgtccgtgcgacgagccgctcggcgaaaacggcggactcgtgatcctgcgtggcaacctcgcgccggacggcgcatgtctgaaaatcgccgggctcaaatcgctttcgttcacgggcgcggtgcgtgtattcgaatgcgaagaagactgcatggcggttgtcgcggcgcgcgactaccgcgaaggcgacgtgctcgtgatccgtaacgaagggccgaaaggcggtcccggtatgcgcgaaatgctgggtgtgacagcagcgatctacggtcagggcatgggcgagaaagtggcgttgttgaccgacggtcggttttcgggcgcgacacgtggcatgtgcatcggctatgtcggcccggaagcggcggcgggtggcccgatcggcctgttgcgcaatgacgaccgcgtgcatatcgacgcgcgcgcaggcattctgcgcgtcgacctgtccgacgacgaactcgcccgtcgccgcgccgacgcgccagcgcgcgcgtcgcgccggctcgcgggggtgctcgaaaaatacgaagcgttggtgcggcccgcgcatctcggcgcggtgacgcattcgggcaacgttgaatggccatacgacgaacccacgcccggcgacgacggagccgccgcatga

SEQ ID NO: 116 - protein, 588 aa, Burkholderia phytofirmans
MTNLHKHRSRRVTDGVTRAPHRAFLRATGLDDESMQKPFVAIVDTFGENTPCSMSLNQVSDNVRLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGTGLQRQSTILTTIEAVGTTQRGDMSRAQLDAIEKQCTPTAGSCPGQFTANTMAMVAETLGLAPLGSAMVPAVYSERIAIARRAGETVMRILTQGGPLPRDLVTMESLENACAAVAATGGSTNAALHIPAIANEAGIRFALDDVQRVFAKIPLIGDLQPGGRYLAQDLHHAGGVPAVLNALLAGGFLHGDVPAFGGGTLAEALSAFSGPDGIVVRPCDEPLGENGGLVILRGNLAPDGACLKIAGLKSLSFTGAVRVFECEEDCMAVVAARDYREGDVLVIRNEGPKGGPGMREMLGVTAAIYGQGMGEKVALLTDGRFSGATRGMCIGYVGPEAAAGGPIGLLRNDDRVHIDARAGILRVDLSDDELARRRADAPARASRRLAGVLEKYEALVRPAHLGAVTHSGNVEWPYDEPTPGDDGAAA

SEQ ID NO: 117 - DNA, 1713 bp, Bordetella petrii
atgtcactgcacaaacaccgctcgcggatggtcaccgacggcctgacccgggcgcctcaccgggcctttctgcgcgccaccgggttcgacgacgaagccctgaagaaatcaatcgttggcattgtcagtacccaaggcgaaaacacgccctgctcgatggccctggcgccccaggcggaccgcgcccgcctgggcgtggcggccgggggcggcgtgccggtcagtttttcgaccatttcggtgtcggatggcacgtccatgaaccatgccggcatgcgcatgagcctgctttcgcgcgaggcgatcgccgacagcgtggaaatggtgatgcgcggccacgcctatgacggactggtggcgttcgccggctgcgacaagacgctgcccgccatgatgatggcgatcgtgcgcctgaacgtgccggcggtgtttctctacggcggcgcgacgttgcccggccacgcgctcggcaagcaggccaccatcctggacaccatcgaggcagtgggccgcgtgcagcatggcggcatgacggccgccgagctcaagaccatggagcgtacttgcacgccatcggccggctcgtgcccgggccaattcaccgccaacaccatggccatggtcggagaagccctgggcttgtcgcccctgggcaccgccatgatgcccgcggtgtacagcgaacgcctggccatcgcccagcgggccggcgaacaagtcatgcgcgccctggcccaaggcggccccctgccgcgcgacctggtcacgcgcgccagcctggacaatgcctgcgccgcggtggctgccaccggcggctcgaccaacgcggcgctgcacattcccgccatcgctcacgaagccggcatccgctacacgctggatgacgttgccgccgtattccagcgcacgccattgatcgcggacttgcagccgggcggacgcttcctggcgcgcgacctgcacgaagcgggcggcgtgcccgccgtactgaaagccctgctggaaggcggttatatcgacggcaacgtgccgacgctcgacggccggccgctggcgcgagccctggtcgacttcgccgggccggacggcgaggtggtgcgcccctgctcgcgcgcgatccacccttcgggcggcgtcacggtgctgaaaggcaacctcagcccgcaaggcgcgctgctcaagatcgcgggcctgaaatcgctgcaattctccgggccggcgcgcgtgttcgaaaacgaagaagactgcatgcgcgcggtgtcacagcgcacctaccagcccggcgacgtgctggtcatccgcaacgaaggcccccagggcgggccgggcatgagagagatgctcagcgtgaccgccgcactgtatggacagggcatgggcgaaaaagtggccctgctgaccgacggccgcttctcgggcgcgacgcgcgggctgtgcatcggttatgtgggccccgaggccgcggcgggcggccccatcgccttcgttcgcgacggcgacatcatccatatcgacgcccaggccaataccttgcgcgtcgaactcagcgacgccgaactggccgcccgccgcgccagccatgtgccgccggcacggccgcgcctggccggcgcgctcgaaaaatacgccttgctggtgcggccggcgcacgaaggcgccgtcacgcactcggggggattggattggccctacgaaaccccggaggccgaatga

SEQ ID NO: 118 - protein, 570 aa, Bordetella petrii
MSLHKHRSRMVTDGLTRAPHRAFLRATGFDDEALKKSIVGIVSTQGENTPCSMALAPQADRARLGVAAGGGVPVSFSTISVSDGTSMNHAGMRMSLLSREAIADSVEMVMRGHAYDGLVAFAGCDKTLPAMMMAIVRLNVPAVFLYGGATLPGHALGKQATILDTIEAVGRVQHGGMTAAELKTMERTCTPSAGSCPGQFTANTMAMVGEALGLSPLGTAMMPAVYSERLAIAQRAGEQVMRALAQGGPLPRDLVTRASLDNACAAVAATGGSTNAALHIPAIAHEAGIRYTLDDVAAVFQRTPLIADLQPGGRFLARDLHEAGGVPAVLKALLEGGYIDGNVPTLDGRPLARALVDFAGPDGEVVRPCSRAIHPSGGVTVLKGNLSPQGALLKIAGLKSLQFSGPARVFENEEDCMRAVSQRTYQPGDVLVIRNEGPQGGPGMREMLSVTAALYGQGMGEKVALLTDGRFSGATRGLCIGYVGPEAAAGGPIAFVRDGDIIHIDAQANTLRVELSDAELAARRASHVPPARPRLAGALEKYALLVRPAHEGAVTHSGGLDWPYETPEAE

SEQ ID NO: 119 - DNA, 1713 bp, Bordetella bronchiseptica
atgtccctgcataagcaccgttcccgcatggttacccaaggcctgacgcgcaccccgcatcgcgccttcctgcgcgccaccggcttcgacgacgccgccctggagaaatccatggtcggcatcgtgagcacgcaaggcgagaacacgccctgctccatggcgctggggccgcaggccgaccgcgcccgcctgggcgtggccgccggcggcggcgtgccggtcagcttctcgaccatctcgatctccgacggcacctcgatgaaccatgcgggcatgcgcatgagcctgctgtcgcgcgagaccatcgccgacagcgtcgagctggtggtgcgcggccacgcctatgacgcactggtggcgttcgccggctgcgacaagacgctgccggccatgatgatggccatcgtgcggctgaacgtgccggcggtgttcctgtacggcggcgccaccctgcccggccatgcggccagcggccaggtcaccatcctcgacaccatcgaagccgtcggccgggtacagcacggcaccatgccggcggccgagctcaaggcgatggagcgcacctgtacgccctcggcgggctcgtgcccgggccagttcaccgccaacaccatggccatggtgggcgaggcgctgggcctgtcgccgctgggttcggcgatgatgcccgcggtctacagcgaacggctggccatcgcgcagcgcgccggcgagcacgtgatgcgcgccctggccgcgggcggcccgctgccgcgccagctggtgacgcgcgccagcctggagaacgcctgcgccgcggtggcggccaccggcggctcgaccaacgcggccctgcacattccggccatcgcgcacgaggccggcatcgccttcacgctggacgacgtggcccgggtgttcaagcgcacgccgctgatcgccgacctgcaacccggcggccgctatctggcgcgcgacctgcacgaggccggcggcgtgccggtggtgctcaaggcgctgctggacggcggccatatcgacggcagcgtgctgacgctcgacggccgcaccctggccgaggccctggccgacacgcccgcgcccgacggcaaggtggtgcgcgcctgcggccaggccctgcaccccaccggcggcgtcgccgtgctcaagggcaatctcagccccgatggcgcgctgctgaagatcgccggcctgaagtcgctgaaattctccgggccggcgcgcgtgttcgagaacgaggaagcctgcatgcgcgcggtgtccacgcacgcctaccagccgggcgaagtcctggtcatccgcaacgaaggcccccggggcgggccgggcatgcgcgagatgctcagcgtcacggccgccctgtatggacagggcatgggcgagaaagtggcgctgctgaccgacggccgcttctcgggcgccacgcgcggcctgtgcatcggctacgccgggccggaagcggccgccggcggccccatcgcgctgctgcgcgatggcgacatgatccacatcgacgccgaggccgatacgctggacgtggcgctgtccgacgaagagctggcgcggcgccgcgccgcctaccaggcgccgccgcaggcgcgcctggccggcgcgctggagaaatacgccgcgctggtgcgcccggcctgcctgggcgcggtcacccactccggccaggtcgattggccttacgaaacgccggaggccgaatga

SEQ ID NO: 120 - protein, 570 aa, Bordetella bronchiseptica
MSLHKHRSRMVTQGLTRTPHRAFLRATGFDDAALEKSMVGIVSTQGENTPCSMALGPQADRARLGVAAGGGVPVSFSTISISDGTSMNHAGMRMSLLSRETIADSVELVVRGHAYDALVAFAGCDKTLPAMMMAIVRLNVPAVFLYGGATLPGHAASGQVTILDTIEAVGRVQHGTMPAAELKAMERTCTPSAGSCPGQFTANTMAMVGEALGLSPLGSAMMPAVYSERLAIAQRAGEHVMRALAAGGPLPRQLVTRASLENACAAVAATGGSTNAALHIPAIAHEAGIAFTLDDVARVFKRTPLIADLQPGGRYLARDLHEAGGVPVVLKALLDGGHIDGSVLTLDGRTLAEALADTPAPDGKVVRACGQALHPTGGVAVLKGNLSPDGALLKIAGLKSLKFSGPARVFENEEACMRAVSTHAYQPGEVLVIRNEGPRGGPGMREMLSVTAALYGQGMGEKVALLTDGRFSGATRGLCIGYAGPEAAAGGPIALLRDGDMIHIDAEADTLDVALSDEELARRRAAYQAPPQARLAGALEKYAALVRPACLGAVTHSGQVDWPYETPEAE

SEQ ID NO: 121 - DNA, 1707 bp, Bradyrhizobium sp.
atgaggaagctgcgttcgcgcgtgacggtggaggggctcgaccgcgccccgcaccgcgccttcatgcgcgcgatgggcctcgatgacgccgacatcgccaagccgatgatcggaatcgtcagtcagaggggcgagcagacgccctgcaacatgacgcacgacttccaggtcgatgccgccaagaccggcatctccgagtccggcggcacgccgcgcgaattcgccaccgtctccgtctccgacggcatcagcatgaaccatgagggaatgaagttctctctgttctcccgcgagctgatcgccgattcgatcgaggccgtggtgcacggcctagcctatgacgcgctgatcggcttcggcggctgcgacaagaccttgcccggcgtgatgatgggtatggtccgctgcaacgtgccgtcgatcttcatctatggcggcagcgcgctgcccggcaagtaccagggcaagacgctcacggtgctcgactcctacgaagcggtcggcagctacatgaccggcgagatcgatgccgccacgctcgaaggcatcgagcgctcgtgcctgccgacgatcggcgcctgcgccggccagttcaccgcgaacaccatgggcatgctgtctgaggcgatgggcctgtcgatgcccaacgtctcgatgatccccggcgtctatgccgagcgcgcccatgtcgcgcgcgcagccgggcgcctgatcatgcagatgctcgccaacgatggcccgcggccgcgcgacatcgtcacccgcaaatccctggagaacggcgcggcgatcgtcgccgccaccggcggctcgaccaacgcggccctgcatctgcctgcgatcgcgaacgaggccggcatccgcttcacgctcgacgatgtcggcgaggtgttttcgcgcacgccgctgatcggcaatctcaggcccggcggcaagtatacggcgaaggacgtgtatgacatcggcggcgcggccgtcgtgatccgcgcgctgatcgacagcggccacatcgacggctcctgcatcacggtgaccggccgtacgctcgccgaggcctgcggcgcggccaatgcgccggatggcgaggtcgtgttcacgccggccaggccgatgatggccgacggcggcgtcgccgtgctcaagggcaatctcgcgccggatggtgcggtcatcaaggtcgccggtctcaagagcctggtgttcgagggccgcgcgcgcgtgtttgaagatgaagaagcctgcgtcgccgccgtccgcgcccgcaactaccaggcgggcgaggtgctgatcatccgtaacgaggggccggtcggcggccccggcatgcgcgagatgctcggcgtcaccgcgctgatctatggccagggcatgggcgagaaggtcgcgctgatcaccgacggccgcttctccggtgccacccgcggtttatgcatcggctacgtctcgccggaagccttcgtcggcggcccgctggcgctggtgcgtgatggcgatcccattcgcatcgatgcgaaagcgcgcacgctcgacgtgctgctcgacgagggcgagctcgccgcgcgtcgcagcgcgtggacgcagcggccgccgcggcatcgcgcgggagcgctggcgaaatacgcgaaactggtggggcaggcgccgctcggcgcggtcacgcatgagggaccggcggaatggccctggttcgatcaggagcaggaatga

SEQ ID NO: 122 - protein, 568 aa, Bradyrhizobium sp.
MRKLRSRVTVEGLDRAPHRAFMRAMGLDDADIAKPMIGIVSQRGEQTPCNMTHDFQVDAAKTGISESGGTPREFATVSVSDGISMNHEGMKFSLFSRELIADSIEAVVHGLAYDALIGFGGCDKTLPGVMMGMVRCNVPSIFIYGGSALPGKYQGKTLTVLDSYEAVGSYMTGEIDAATLEGIERSCLPTIGACAGQFTANTMGMLSEAMGLSMPNVSMIPGVYAERAHVARAAGRLIMQMLANDGPRPRDIVTRKSLENGAAIVAATGGSTNAALHLPAIANEAGIRFTLDDVGEVFSRTPLIGNLRPGGKYTAKDVYDIGGAAVVIRALIDSGHIDGSCITVTGRTLAEACGAANAPDGEVVFTPARPMMADGGVAVLKGNLAPDGAVIKVAGLKSLVFEGRARVFEDEEACVAAVRARNYQAGEVLIIRNEGPVGGPGMREMLGVTALIYGQGMGEKVALITDGRFSGATRGLCIGYVSPEAFVGGPLALVRDGDPIRIDAKARTLDVLLDEGELAARRSAWTQRPPRHRAGALAKYAKLVGQAPLGAVTHEGPAEWPWFDQEQE

SEQ ID NO: 123 - DNA, 1707 bp, Bradyrhizobium sp.
atgaggaagctgcgctcgcgcgtcacggtggaggggctcgatcgtgccccgcaccgcgccttcatgcgcgcgatggggctggatgatgccgacatcgccaagccgatgatcggcatcgtcagccagaagggcgagcagacgccctgcaacatgacgcacgacttccaggtcgacgccgccaagacgggcgtctccgaagccggtgggacgccgcgcgaattcgccaccatctcggtgtcggacggcatcagcatgaaccatgagggaatgaagttctctctgttctcgcgcgaactgatcgcggattcgatcgaggccgtggtccatggtctcgcttatgacgcgctgatcggctttggcggctgcgataagaccctgccgggcgtcatgatgggcatggttcgttgcaacgtgccgtcgatcttcatttatggcggcagcgctctgcctggcaagttccagggcaagacgctcacggtgctcgattcgtatgaagcggtcggcagctacatgaccggcgagatcgatgtcgcgacgctcgagggcatcgagcggtcgtgcctgcccaccatcggcgcctgcgccgggcagttcaccgccaacaccatgggcatgctgtccgaggcgatgggcctgtcgatgcccaacgtctcgatgatccccggcgtctatgccgagcgcgcccatgtcgcgcggcaggccggccggctgatcatgcagatgctggctcgtggtgggccgctgccacgcgatatcgtgacccgcaaggccctggagaacggtgcggcgatcgtcgccgccaccggcggctcgaccaatgccgcgctgcatctgccggcgatcgccaacgaagccggcatccgtttcacgctcgacgatgtcggcgaggtcttcgcccgcacgccgctgatcggcaatctccggccgggcgggaagtacaccgccaaggacgtctatgacatcggcggcgcggccgttgtgatccgcgcgctgatcgagagcggccatatcgacggctcctgcatgacggtgaccggccgcacgcttgccgaggactatggggccgccaatgcgcccgatggcgagatcgtgtttcatccggccagcccgatcatggcggagggcggcgtcgccgtgctcaagggcaatctggcgcctgacggcgcggtcatcaaggtggccggcctgaagaacctcgtattcgaggggcgggcccgcgtattcgaggatgaggaagcctgcgtcgccgccgtccgcgcgcgcaactatcaggcgggcgaggtactgatcatccgcaacgaggggccggtcggcggtcccggcatgcgcgaaatgctcggtgtgaccgcactgatctacggtcagggcatgggcgagaaggtggcgctgatcaccgacggccgcttctccggagcgacgcgcggcatgtgcattggctatgtctcgccggaagccttcgtcggcggtccgttggcgctgctgcgcgacggcgatccgattcgcatcgatgcaaaagcgcgcacgctcgacgtcctgctcgacgacgccgagctcgcggcccgtcgcgccgcgtggtcgcagcggccgccacggcatcgcgccggcgcgctggcgaaatatgccaagctcgtcggccaggcaccgctcggcgccgtgacgcatgaaggacccgcggactggccgtggttcgatcaggagcagaaatga

SEQ ID NO: 124 - protein, 568 aa, Bradyrhizobium sp.
MRKLRSRVTVEGLDRAPHRAFMRAMGLDDADIAKPMIGIVSQKGEQTPCNMTHDFQVDAAKTGVSEAGGTPREFATISVSDGISMNHEGMKFSLFSRELIADSIEAVVHGLAYDALIGFGGCDKTLPGVMMGMVRCNVPSIFIYGGSALPGKFQGKTLTVLDSYEAVGSYMTGEIDVATLEGIERSCLPTIGACAGQFTANTMGMLSEAMGLSMPNVSMIPGVYAERAHVARQAGRLIMQMLARGGPLPRDIVTRKALENGAAIVAATGGSTNAALHLPAIANEAGIRFTLDDVGEVFARTPLIGNLRPGGKYTAKDVYDIGGAAVVIRALIESGHIDGSCMTVTGRTLAEDYGAANAPDGEIVFHPASPIMAEGGVAVLKGNLAPDGAVIKVAGLKNLVFEGRARVFEDEEACVAAVRARNYQAGEVLIIRNEGPVGGPGMREMLGVTALIYGQGMGEKVALITDGRFSGATRGMCIGYVSPEAFVGGPLALLRDGDPIRIDAKARTLDVLLDDAELAARRAAWSQRPPRHRAGALAKYAKLVGQAPLGAVTHEGPADWPWFDQEQK

SEQ ID NO: 125 - DNA, 1749 bp, Bradyrhizobium japonicum
atgaagttgcgatgtcccgccgcgtacgggacatcgcacgtagatgatgcaaatatgaagaagttgcgatcacggataacgacagacggcctcgaccgggccccgcaccgcgcattcatgcgcgcaatggggctggacgatgcggcaatcgccaagcccatggtaggcattgtcagcatgaagggcgagcagacgccctgcaacatgacccacgacttccaggtggccgcggccaagacaggtattgaggaggccggcggcacgccgcgcgaattctcgaccgtgtcggtctctgacgggatcagcatgaatcacgagggaatgaagttctccctcttttcgcgcgagctgatcgccgactcgatcgaggctgtcgttcatggtctcgcctatgacgcgttgatcggatacggcggatgcgacaagacgcttcccggcgtgatgatgggcatggttcgttgcaacgtgccgtcgattttcatctacggcggcagttcgctgccggggcgcgtggacggacgaacgctgacagtgctcgactcctacgaggctgtcggcagcttcatgaccggagagatcgatagcgccacactggagcggatcgagcgcgcctgcctgccgaccatcggtgcgtgcgcgggccagtttactgcgaacaccatgggaatggtgtcggaggcgatggggctcaccattcccaacgtctcgatggtgcccggtgtctacgccgagcgcgcgcagatctcgcgacgcgccgggcggctgatcatggaaatgctggaacgcggtgggccgctgccacgggacatcgtgacgcggaaatccctcgagaacggggcggcgatcgtcgccgctacgggcggctcgaccaacgccgcgctgcatctgcccgccatcgcgaacgaggccggcatcgcattcacgatcgacgatgtcggcgaggtctttgccaggacgccgctgatcggaaatctgcggcccggaggcaaatacacggcgaaggatgtccacgacataggtggcgccgccgtggtgatccaggagttgatcagaaccggtcatatcgacggtaactgcatcaccatcaccggccggacgcttgccgaagaatatggcgcggccaacgcgccggacggtgaggtcgtttacgcggcaagtgcgccgatcatgccggatggcggtgtcgcggtgctgaagggcaacctctgtccggacggtgcggtcatcaaggtcgcaggtttgaagagccagttcttcgagggtgtcgcgcgcgttttcgaagacgaggaggcttgcgtcgcagcggttcgcgaccgcagctacaaggcaggtgaggtcctggtgatccgcaacgaagggccggtcggcggccccggtatgcgcgagatgctcggcgtcaccgcgctgatctacgggcagggcatgggcgaaaaggtggccctgatcaccgacgggcggttctccggcgcgacccgcggcatgtgtatcggctacgtgtcccccgaagcattcgttggcggtccgttggccctcgttcgcgacggcgacaagatccggattgatgctacaaaccggcgtatggatatgctggtcgacgagccggagctcgcggcgcgccgacgtgattggaaaccacgcccgccgcgtcaccgcgcaggcgcgctcgcaaaatatgcgcgactggtcggccaggcgccgggcggagcggttacccatgaggggcccgcagaatggccctggttcgaatga

SEQ ID NO: 126 - protein, 582 aa, Bradyrhizobium japonicum
MKLRCPAAYGTSHVDDANMKKLRSRITTDGLDRAPHRAFMRAMGLDDAAIAKPMVGIVSMKGEQTPCNMTHDFQVAAAKTGIEEAGGTPREFSTVSVSDGISMNHEGMKFSLFSRELIADSIEAVVHGLAYDALIGYGGCDKTLPGVMMGMVRCNVPSIFIYGGSSLPGRVDGRTLTVLDSYEAVGSFMTGEIDSATLERIERACLPTIGACAGQFTANTMGMVSEAMGLTIPNVSMVPGVYAERAQISRRAGRLIMEMLERGGPLPRDIVTRKSLENGAAIVAATGGSTNAALHLPAIANEAGIAFTIDDVGEVFARTPLIGNLRPGGKYTAKDVHDIGGAAVVIQELIRTGHIDGNCITITGRTLAEEYGAANAPDGEVVYAASAPIMPDGGVAVLKGNLCPDGAVIKVAGLKSQFFEGVARVFEDEEACVAAVRDRSYKAGEVLVIRNEGPVGGPGMREMLGVTALIYGQGMGEKVALITDGRFSGATRGMCIGYVSPEAFVGGPLALVRDGDKIRIDATNRRMDMLVDEPELAARRRDWKPRPPRHRAGALAKYARLVGQAPGGAVTHEGPAEWPWFE

SEQ ID NO: 127 - DNA, 1686 bp, Sphingomonas wittichii
atggcgttgaaggacgggaagggcgagacgcttccctcgcggacgatcaccgacgggctcgaccgcgccccgcaccgcgccttcctgcgggcgatggggcatgacgacgtggcgatcggccagcccttcgcgggcatcgtctcgaccggggcgtcggtgacgccctgctcgatgtcgctggcgcctcaggccgaggcggcgaaggccgggctccaggcggcgggggtgacgccgttcgaattctcgacgatcaccgtcgccgacagcatgtcgatgaaccatgccgggatgcgtttcagcctggtctcgcgggagatcatcgccgattcgatcgaggcggtgacgcgggcgcatggctatgacgggctgatcggcttcgcggcctgcgacaagacgttgccgggcacgatgatggggatgatccgggtcaaccgcccgtcggtgttcgtctatggcggcgcggcgctgcccggccgctggcaggggcgcgacatcggcatcgtcgacgtctatgagggcgtcggccgggtctatgccggcgagatggacgaggccgagctgacgcgcctcgaaaaggcgggggtgccgaccgtcggctcctgcgccgggcagttcaccgccaacaccatggcgatggtcgccgagacgctgggcctggcgctgccgcgcagcgcgatgatgccggcggtggcgagcgagcgccgcgcgctggccgaggaatcgggccgcgtgctcggccggctgatccgcgagggcggcccgcgcccgcgcgacctcgtcacccgtcgcagcctcgaaaacgccgccgccaccgttgccgccaccggcggctcgaccaacgccgcgctgcacctgccggcgatcgcacatgaggcaggcatatccttcaccatggaggacatcgccgcgatcttcgaccgcaccccgctgctcgccgacctcaagcccggcggccgcttctgggcgcgcgacctgcacgaggtcggcggcgtgccgaccgtgctgcgggcgatgctggaggcgggcgtgctgcacggcgactgcccgaccatcaccggccggacgatcggcgagatcgccgccgccgcgcccgcgccggacggggaggtggtgcgccccgccgaccggccgatcgcgccgaccggcggggtgatcgtgctgcgcggcagcctcgcccccgacggcgcgatgctcaaggtcgccgggctcaagcgcctgtcgcacgaagggccggcgcgggtgttcgacggcgaggaggcggcggtcgacgcggtccgccggcaggattaccagccgggcgacgtcatcgtcatccgtggcgaggggccgaagggcggccccggcatgcgtgagatgctgggcgtcaccgcgctgatctacggccagggcatgggcgaacaggtcgcgctgctcaccgacggccgcttctcgggcgcgacgcgcggcatgtgcatcggccatgtcggcccggaggcctcggccggcggcccgctcgcgctggtccgggacggcgatcgcatccgcatcgacgcgggccagcgcacgctcgacctgctcgtcgatgccgccgagctggagcgccgccgcgcggcctggaccgcgccggaggctaccgtcacctcgccgaccttgcgcaaatatgcgcggctcgtcgggccggcgcatctcggcgccgtcacccactga

SEQ ID NO: 128 - protein, 561 aa, Sphingomonas wittichii
MALKDGKGETLPSRTITDGLDRAPHRAFLRAMGHDDVAIGQPFAGIVSTGASVTPCSMSLAPQAEAAKAGLQAAGVTPFEFSTITVADSMSMNHAGMRFSLVSREIIADSIEAVTRAHGYDGLIGFAACDKTLPGTMMGMIRVNRPSVFVYGGAALPGRWQGRDIGIVDVYEGVGRVYAGEMDEAELTRLEKAGVPTVGSCAGQFTANTMAMVAETLGLALPRSAMMPAVASERRALAEESGRVLGRLIREGGPRPRDLVTRRSLENAAATVAATGGSTNAALHLPAIAHEAGISFTMEDIAAIFDRTPLLADLKPGGRFWARDLHEVGGVPTVLRAMLEAGVLHGDCPTITGRTIGEIAAAAPAPDGEVVRPADRPIAPTGGVIVLRGSLAPDGAMLKVAGLKRLSHEGPARVFDGEEAAVDAVRRQDYQPGDVIVIRGEGPKGGPGMREMLGVTALIYGQGMGEQVALLTDGRFSGATRGMCIGHVGPEASAGGPLALVRDGDRIRIDAGQRTLDLLVDAAELERRRAAWTAPEATVTSPTLRKYARLVGPAHLGAVTH

SEQ ID NO: 129 - DNA, 1683 bp, Rhodobacterales bacterium
atgaccaaacgcgacacgctcatctcacgcaccatcgtggaggggctcgaccgtgcgccccaccgcgccttcctgcgcgcgatggggcacgacgacacggcactggccagcccgttcgtcggcatcgcacataccgcgagcgaggtgacgccctgcaccatgtcgctcccgccgcagatccagtcggccaagttaggcatcacccgcgaaggaatgaccccgttcgaattcggcacgatcaccgtggccgacagcatgtcgatgaaccatcgcgggatgcgcttttcgctcgtctcgcgtgagatcatcgcggacagcatcgacgcagtggtgcgcggccatgcctatgacgggctgatgaccttcgcctcctgcgacaagacgctgccgggcatgttgatggccatcgcgcgcatcaaccgcccttcggtctttctgtatggcggggccgcgctgccgacgccgtggaacgggcaggacatcggggtggtcgacgtctacgaaggcgtggggcgcgtctatgaggggacatcgagcgaggaagagctcgacgcgatggaacgggtgggcgtgcccactgtcggctcctgcgccgggcagttcacggccaacaccatggcgctcgtggccgaggttctgggcttggcccccctcggtgtcgcctaccttcccgccgtctattccgaacggcaggcactggtgaaacgcgcggcgggtctgttgcgccgcgcggtggacgagaacggcccgctgccctcggacctcatcacgcgcgagtcgctggaaaacgccgtggtcgctgtgggcgcgacgggcgggtcgaccaatgccctcctgcacctgcccgcaatcgcgaacgaggtcgggatcagcttcacgctggacgacatcgcgaaggtgcttgaggacgtgccgctggtcgccgacctgaaacccggcggcgcctactgggcgcgcgacatgcaccacgtgggcagcaccccggcgctcctgcgcgtgttgaagggggcgggcgtgctgcacacggacacgccgagtgtcgagggccggacgctgggtgaactggccgacaccggacctgaagcggacggcaaggtgatccgagccgtgggcaatccggtcacgccgacctcaggcgtggtggtgctcaaggggtcgctcgcccccgaaggggcggtgctcaaggtcgcgggtctcaagcacacagttcacgaaggccccgcgcgggtgttcgagtgcgaggaggatgccgtggccgccgtgcgcaagcgcgaatacgaggcgggcgacgtgattgtgatccgcaacgaaggccccaagggcgggccggggatgcgcgagatgctgggcgtcaccgcgctcctctacggtcagggcatgggcgagaaggtcgcgctcatcaccgacggccgcttctcaggcgcgacgcggggtctgtgcatcggtcacgtcgggcccgaggcggcggcgggtggtcccatcggcctgatccgcaccggcgacatcatccagatcgacgcgggcaaacgggagttgaacgtcaaactatcgacagacgagcttgcccggcgcacccgccccccggtgcccgaggggctggaacccgaaacggcgaccctgcgcaaatacgcggctctcgtcggccccgcgcatctgggcgcgaccacgcaccggaacacctag

SEQ ID NO: 130 - protein, 560 aa, Rhodobacterales bacterium
MTKRDTLISRTIVEGLDRAPHRAFLRAMGHDDTALASPFVGIAHTASEVTPCTMSLPPQIQSAKLGITREGMTPFEFGTITVADSMSMNHRGMRFSLVSREIIADSIDAVVRGHAYDGLMTFASCDKTLPGMLMAIARINRPSVFLYGGAALPTPWNGQDIGVVDVYEGVGRVYEGTSSEEELDAMERVGVPTVGSCAGQFTANTMALVAEVLGLAPLGVAYLPAVYSERQALVKRAAGLLRRAVDENGPLPSDLITRESLENAVVAVGATGGSTNALLHLPAIANEVGISFTLDDIAKVLEDVPLVADLKPGGAYWARDMHHVGSTPALLRVLKGAGVLHTDTPSVEGRTLGELADTGPEADGKVIRAVGNPVTPTSGVVVLKGSLAPEGAVLKVAGLKHTVHEGPARVFECEEDAVAAVRKREYEAGDVIVIRNEGPKGGPGMREMLGVTALLYGQGMGEKVALITDGRFSGATRGLCIGHVGPEAAAGGPIGLIRTGDIIQIDAGKRELNVKLSTDELARRTRPPVPEGLEPETATLRKYAALVGPAHLGATTHRNT

SEQ ID NO: 131 - DNA, 1665 bp, Solibacter usitatus
atgaaactgcagagccataccatcactcagggacgagatcgcgccccggcgcgcgccatgttgaaagcgatcgggtttaccgatgaagatctggccaagccgatcatcgggatcgccaacacctggatcgagaccatgccgtgcaattacaacctgcgtgagctggccggcaaagtgaaggagggcatccgcgccgccggcgggacgccgatggagttcaacaccatcgcgatcagcgacggcgtcaccatgggcacggaaggcatgaaggcctcgctgatcagccgtgaagtaatcgcggattccatcgagctgatggtgcgcggccacatgttcgatggcatcgtcgccatggtggcctgtgacaagaccattcccggcgccgcgatggcgctgctccgcctcaacgtcccgggcgtggtgctttatggcggcaccatcatgccgggccgcttcgagggtcacgacatcacgattcaggacgtgtttgaagccgtcggcgcgcacgcgcgcggcaagatcaccgacgcgcaattgctcgacatcgaagaccacgcctgccccggcgccggagcctgcggcggacagttcacggccaacaccatggccaccgtgatggagctgatcggactctccccgatgggcacggctgccgttccccaggtggacaagcgcaaagacgcagtggcgtaccgctgcggcgaggttattctgaacgccgtgcgcaagaacattctgccgcgcgatatttgcacccgcaaagccttcgagaatgcgattgcaggcgtcgccggaacggccgggtccaccaacgccgtgctgcacctgctggccatggcgcgcgaagccgaagtgccgctgaccatcgatgagtttgaaccggtgctggcgcggacgccggtcttcgtcgatatcaaacccggcggaaagtacatggccgcggacgtggataaggccggcggcattccggtgatcgccaaccgcctgctcgagggcggctacgtggatggctcggcgatcacgatcaccggacgcaccttcgccgaagaagcgaacgaggccaaggaagtcgccgggcagccggtgattcttccgctcgccaaagcgctcaagccgcgcggcggtatcgcgattcttcgcggctctctggcgcccgaaggctgcgtgatcaagctggcaggccacgagaagaaatcgcaccacggtccggcgcgcgtgttcgagcgtgaggaagaggccatggcggccgtgcaggaaggcaagattcgcgagaacgacgtggtagtgatccgctacgaaggtccgcgcggcggccccggcatgcgcgagatgctgggcgtcaccggagccattgtcggcgccggtctgagcgatagcgtagcgctcttgaccgatggccgcttcagcggcgccacgcacggtttcatgatcgcgcacgtggcacccgaggcctttaacggcggcccgatcgcggtcgttcaggaaggcgacatgatcacggtggacgcaacccgcggcgtgcttgaattggatattcccgccggggaactgaagagccggctggccgcatggaagccccgcgaaccccgttacaagaaaggcgtgatcgcgaagtactgcaagctggtttcaagcgcgagcgaaggcgcgatcactcaagcatga

SEQ ID NO: 132 - protein, 554 aa, Solibacter usitatus
MKLQSHTITQGRDRAPARAMLKAIGFTDEDLAKPIIGIANTWIETMPCNYNLRELAGKVKEGIRAAGGTPMEFNTIAISDGVTMGTEGMKASLISREVIADSIELMVRGHMFDGIVAMVACDKTIPGAAMALLRLNVPGVVLYGGTIMPGRFEGHDITIQDVFEAVGAHARGKITDAQLLDIEDHACPGAGACGGQFTANTMATVMELIGLSPMGTAAVPQVDKRKDAVAYRCGEVILNAVRKNILPRDICTRKAFENAIAGVAGTAGSTNAVLHLLAMAREAEVPLTIDEFEPVLARTPVFVDIKPGGKYMAADVDKAGGIPVIANRLLEGGYVDGSAITITGRTFAEEANEAKEVAGQPVILPLAKALKPRGGIAILRGSLAPEGCVIKLAGHEKKSHHGPARVFEREEEAMAAVQEGKIRENDVVVIRYEGPRGGPGMREMLGVTGAIVGAGLSDSVALLTDGRFSGATHGFMIAHVAPEAFNGGPIAVVQEGDMITVDATRGVLELDIPAGELKSRLAAWKPREPRYKKGVIAKYCKLVSSASEGAITQA

SEQ ID NO: 133 - DNA, 1680 bp, Roseiflexus sp.
atgtctagcgacctcaaacgccgcagtcgcaccattaccgatgggcgcacccgcgccggggcgcgcgccatgctcaaggcaatcggcttcaccgacgaagacctggcaaaaccgatcatcggcatcgccaatacctggatcgagacgatgccatgcaacatcaacctgcgcgcgctggcggcgcgggtcaaggaaggcgtgcgcgccgccggcggcacgccgatggagttcaacaccgtcgctatcgccgatggcgtcaccatgggtacggaagggatgaaggcgtcgctgatcagccgcgacctgattgccgactcgatcgaactgatggggcgcgggtatatgttcgacgcgatcatcgcgctggtggcatgcgacaaaacgatccccggagcagcgatgggattgacgcgcctgaacatccccggcttcctgctctacggcggatcgattgctcccggtcactggcgcggcaaagagatcaccatccagcatgtgtacgaagcgatcggtgcagttgccgccggtaagatgaccgacgaagaactgaaagagatcgaagatgccgcgtgccccggtccgggagcatgcggaggtcagtacactgccaacacgatggcaaccgtgatggaaattatcggtctctcgccgatggggacggctgcggtgccggctgccgacccgcgcaaagattcggttggataccgcgccgggcagttgattatggatgtgctgcgacgcgatctgaagccgcgcgatattctgacacgggcggcattcgagaatgcgatcgccagcgtggcgttgaccggcggctcgaccaacgcggtactccatctgctggcgctggcgcgtgaggcgggcgtgccgctaacgctcgacgatttcgacgcgatcagtcgtcgtacaccgctctgctgcgacctgatgccgagcgggaagtactctgccattcacgtcgatcaggcgggcggcattcaggtgattgcgagacgcctggtcgacggcggtttcgcgcacggcgatgcgatcaccgtcactggtcgcaccctggcggaagaggcggcggatgctgtcgaaacgccaggtcaggatgtgatccgtcccctcgataatccgatcaagccgacaggcgggttgctggtgctgcgcggcaatctggcgcccgaaggatcggtggtcaaactgttcggttatgagcgcacctaccaccgcggtccggcgcgcgtcttcgatggcgaagaggcggcaatggccgctatcgtcggcggtgaaattcgaccggacgatattgtgattattcgctatgaaggtccgcgcggcggtcctggcatgcgcgagatgctcggcgttacttccgcgattgtcggcgccggacttgggcagtcggtctcgctcattactgatggacgcttcagcggcgcgacgcgcggtgtgatgatcggacacgtggcgccggaggcggcgcgaggcggaccgcttgcgattgtgcaggagggggatgagatcgagatcaatctcgacgagcgccgtgttgatctgctgctgtcagaagaagagattgccgaccggttgctcgcctggcagccgccagcgccgcgttatgagtggggcgtgatggcgcgctacggtgcgctggtgtcgtcagcgtccgaaggcgccgtgctggtgacaccatga

SEQ ID NO: 134 - protein, 559 aa, Roseiflexus sp.
MSSDLKRRSRTITDGRTRAGARAMLKAIGFTDEDLAKPIIGIANTWIETMPCNINLRALAARVKEGVRAAGGTPMEFNTVAIADGVTMGTEGMKASLISRDLIADSIELMGRGYMFDAIIALVACDKTIPGAAMGLTRLNIPGFLLYGGSIAPGHWRGKEITIQHVYEAIGAVAAGKMTDEELKEIEDAACPGPGACGGQYTANTMATVMEIIGLSPMGTAAVPAADPRKDSVGYRAGQLIMDVLRRDLKPRDILTRAAFENAIASVALTGGSTNAVLHLLALAREAGVPLTLDDFDAISRRTPLCCDLMPSGKYSAIHVDQAGGIQVIARRLVDGGFAHGDAITVTGRTLAEEAADAVETPGQDVIRPLDNPIKPTGGLLVLRGNLAPEGSVVKLFGYERTYHRGPARVFDGEEAAMAAIVGGEIRPDDIVIIRYEGPRGGPGMREMLGVTSAIVGAGLGQSVSLITDGRFSGATRGVMIGHVAPEAARGGPLAIVQEGDEIEINLDERRVDLLLSEEEIADRLLAWQPPAPRYEWGVMARYGALVSSASEGAVLVTP

SEQ ID NO: 135 - DNA, 1701 bp, Rubrobacter xylanophilus
atgcagaccacggacctcaggcgcaagagccgcatcatgttcgaggggcgggaccgggcccccgcccgctcctaccttctgggcatgggctacactcgggaggacctcgagaagcccatcgtgggggtggcccactcctggatcgagaccatgccctgcaactacaaccaccgccggctggccgagaaggtcaaggagggcatccgggcggccgggggcacccccatggagctgaacaccatcgcgatctccgacgggatcacgatgggcacccaggggatgaagacctccctggtctcgcgcgaggtgatcgccgactccatcgagctggtggggcgcggccacatgttcgacgccatggtgatcctggtcggctgcgacaagaccatccccgccggggcgatggcgctggcccggctggacgtccccggcatggtcatctactccggctccatagccccggggcgcttcaggggccgcgacgtgaccatccaggacgtcttcgagggggtgggcgcccacgccgcgggcaagatgagcgacgaggagctgcgggagctggaggagggggcctgcccgggcgcgggggcctgcggcggccagtacaccgccaacaccatggccatagcgctgcagtttttgggcctctcgccggtgggctccgccgacccgcccgccctggacggccgcaaggaggcggtctgcgaggaggcgggccggctggtgatgcgcctgctggagcgggacctcaagccctcggacatcctgagccgcgcggccttcgagaacgccatcgcctccgtggccgctaccgggggctccaccaacgcggtgctccacttcctcgccctcgcccaggaggcgggcatcccgctggacatagaggacttcgaccgggtcagctcccgcacccccatcatcgcggacctgaagcccggcggccgctttacggccgtggacatggaccgcgcagggggctcccggctgctgggcgcgcggatgctggaggcgaacctcgtggacggctcccagcccaccgtcaccgggcgcaccctggccgaggagttcgagggcgcgcgggagcgcccggggcaggaggtgatcctctccgccgagaggtccctcagcgagagcggcggcctggtgatcctcaagggcaacctggcccccgagggctgcgtggtgaaggtcgcgggctacacccgccgccgccacgagggtccggcgcgcgtcttcgactccgaggagcaggcgatggaggcggtccaggccggccggatctcggcgggcgacgtggtggtgatccgctacgaggggccgcgcggcggccccgggatgcgcgagatgctgggggtgaccgccgcgctggtgggccaggggctcggcgagagcgtggcgctgctaaccgacgggcgcttctcaggggccacccgcgggctcatggtgggccacgtcgccccggaggcggcccgcggcggccccatagccgccctgcgcgacggggaccgcatcacgatcgacgtcaccggcaggacgctgagcgtggcgctcaccggcgaggagctgcggaggcgcctggagaactggcgggagcccgagccgcgcttcaggctcggggtgatggccaagtacgccgccctcgtctcctcggcctccgagggggcggtgaccgtcccggactggcagcgccgcgccacctga

SEQ ID NO: 136 - protein, 566 aa, Rubrobacter xylanophilus
MQTTDLRRKSRIMFEGRDRAPARSYLLGMGYTREDLEKPIVGVAHSWIETMPCNYNHRRLAEKVKEGIRAAGGTPMELNTIAISDGITMGTQGMKTSLVSREVIADSIELVGRGHMFDAMVILVGCDKTIPAGAMALARLDVPGMVIYSGSIAPGRFRGRDVTIQDVFEGVGAHAAGKMSDEELRELEEGACPGAGACGGQYTANTMAIALQFLGLSPVGSADPPALDGRKEAVCEEAGRLVMRLLERDLKPSDILSRAAFENAIASVAATGGSTNAVLHFLALAQEAGIPLDIEDFDRVSSRTPIIADLKPGGRFTAVDMDRAGGSRLLGARMLEANLVDGSQPTVTGRTLAEEFEGARERPGQEVILSAERSLSESGGLVILKGNLAPEGCVVKVAGYTRRRHEGPARVFDSEEQAMEAVQAGRISAGDVVVIRYEGPRGGPGMREMLGVTAALVGQGLGESVALLTDGRFSGATRGLMVGHVAPEAARGGPIAALRDGDRITIDVTGRTLSVALTGEELRRRLENWREPEPRFRLGVMAKYAALVSSASEGAVTVPDWQRRAT

SEQ ID NO: 137 - DNA, 1779 bp, Salinispora tropica
gtgacgacccggcctaacccactcttcgtcggcatcgagcgcgccccagcgcgcgcctccatgcgcgccacaggtctgtcgaccgaggacctgaagaagccgatgatcggggtagcgcacagttggatcggcacgatgccgtgcaacctcaaccaccggcggctcgcccaggaggtgatggccggcgtgcgcgccgcaggtggcaccccgatcgagatcaacaccatcgcgatctcggacgtgatcaccatgggcacggagggaatgcggacctcactggtgagccgcgaggtgatcgccgactccatcgagttggtatgccgcggccacggtctcgacggcctggtgaccctggccggctgtgacaagaccatacccggtgcggcgctggcccacgtgcgactcgacatccccggagccgtcatctattccggcacgatgatgccgggcgagcacctcgggcgcgacatcaccctgcaggatgtgtttgaggccgtcggcagcgccaccgccaccggctgcaccgacgagctcgacaagctcgagcgcgcggcctgtcccggtatcggggcctgcgcgggccactacacggccaatacgatggccgtggtgctggagttcctcgggctttccccgttcggctcgatggatccgccggcagtcgacgcccgcaaggacacggtctgccgccaggccggcgagctggtcatgcgggcggtggcagaagggctgcggcccagccggttcctgacgccctcctcgttgcgcaacgccatcgccgccggggtcgccaccggcggctcgacgaacatggtgctccacctgttggcgatcgctcgggaggcgggcatcccgctggacattgacgagttcgaccggatcagctcggtgaccccgatcatcgctgacctgcgtccaaacgggacgtacaccgcggtggacctcgaccgggcgggcggcacccgggtgatcgcccgccacatggtcgacgcgggcctgattgctggcgacgaaagcaccgtcaccggccgcaccgtcgcacacgaggccgcggacgcggccgagacacccggccaacgggtcgtcaccacggtggaggcacccctatcgccttccggtgctctcctgatcttgcggggtaacctagcgcccgatggcagtgtggtgaaggcacccggcgcggtgaccctgcggatgaccggcaccgcattggtgttcaactgcgaggaggaagcgatggccgcggtccagactggccgcgtccggccaggccacgtcgtcgtcatccgctacgagggtccgcgcgggggtccagggatgagggaaatgctcggagtgacctcggcgctcatcggccgcggcctgggcacgtcggtcggtctggtgaccgacggccgtttctcgggcgcgaccaggggactgatggtggggcacgtcgctccggaggcggcggagggcggaccgatcgcggcggtgtgcgacggtgaccggatcaccatcgacctgcagcggcgcgaatgctctgtcgacctggatccgggcgaactggccgcgcggatgcgagactggtcggctccgccaccgcgctacacgatcggcgtcatggccaaatactggtcgacggtctcgtcggcggccgtgggcgccgtgacgaccccgcaccccacccagggcccggcgacagcgtcaggtaaggccgaggagtgccagcaggcgagtgcggtcgagggcgtgatggcggttggcggcggcgatgtcggtgctgccggcggttcgtag

SEQ ID NO: 138 - protein, 592 aa, Salinispora tropica
MTTRPNPLFVGIERAPARASMRATGLSTEDLKKPMIGVAHSWIGTMPCNLNHRRLAQEVMAGVRAAGGTPIEINTIAISDVITMGTEGMRTSLVSREVIADSIELVCRGHGLDGLVTLAGCDKTIPGAALAHVRLDIPGAVIYSGTMMPGEHLGRDITLQDVFEAVGSATATGCTDELDKLERAACPGIGACAGHYTANTMAVVLEFLGLSPFGSMDPPAVDARKDTVCRQAGELVMRAVAEGLRPSRFLTPSSLRNAIAAGVATGGSTNMVLHLLAIAREAGIPLDIDEFDRISSVTPIIADLRPNGTYTAVDLDRAGGTRVIARHMVDAGLIAGDESTVTGRTVAHEAADAAETPGQRVVTTVEAPLSPSGALLILRGNLAPDGSVVKAPGAVTLRMTGTALVFNCEEEAMAAVQTGRVRPGHVVVIRYEGPRGGPGMREMLGVTSALIGRGLGTSVGLVTDGRFSGATRGLMVGHVAPEAAEGGPIAAVCDGDRITIDLQRRECSVDLDPGELAARMRDWSAPPPRYTIGVMAKYWSTVSSAAVGAVTTPHPTQGPATASGKAEECQQASAVEGVMAVGGGDVGAAGGS

SEQ ID NO: 139 - DNA, 1722 bp, Acidobacteria bacterium
atgaccgaaaaatccccaaagccacacaagcgtagcgacgccattaccgaaggtcccaaccgcgccccagcccgcgccatgctgcgcgccgccgggttcaccccggaagaccttcgtaagcccatcatcggcatcgccaacacctggatcgaaatcggtccctgcaacctgcaccttcgtgagctcgccgagcacatcaagcagggcgttcgcgaagccggcggtacgccaatggagttcaacaccgtctccatttctgacggcatcaccatgggctcggaaggcatgaaggcgtcgctggtcagccgcgaggtcatcgccgactccatcgaactcgtcgcgcgcggcaatcttttcgacggcctgatcgccctatcgggatgcgataaaaccatccccgggaccatcatggcgctcgagcgcctcgacatcccgggtctcatgctctatggcggctccatcgcgcccggcaaattccatgctcagaaggtcacgattcaagacgtcttcgaggcagtcggtacgcatgcgcgcggcaaaatgagcgacgctgatctcgaagaactcgaacacaacgcctgtcccggcgccggcgcctgcggtggacaattcaccgctaacaccatgtccatgtgcggcgaattcctcggcatctcgccgatgggcgctaacagcgtcccggcgatgaccgtagagaagcagcaggtcgcacgacgctgcggacacctcgtcatggaactggtccgccgcgacatccgccccagccaaatcatcacgcgcaaggcgatcgaaaacgcaatcgccagcgtcgccgcctccggcgggtcgaccaacgccgttcttcacttgctcgccatcgcgcacgaaatggacgtcgaactgaacatcgaagacttcgacaagatcagttcgcgcacgccactgctctgcgaactcaagcccgctggccgcttcaccgccaccgatcttcatgatgccggcggtattccgctcgtcgcgcaacgcctgctcgaagcgaacctgctgcacgccgacgcactgactgtcaccggtaagaccatcgccgaagaagcgaagcaggcgaaagaaacgccgggccaggaagtggttcgtccgcttaccgatcccatcaaagctaccggcggcctcatgatcctgaaaggcaacctcgcatccgaaggctgcgtggtcaaactcgtcggacacaagaagctcttctttgaaggccccgctcgcgtcttcgagtcggaagaagaagcctttgcgggcgtggaagaccgcaccatccaggcgggcgaagtggtcgtggtccgatatgaaggcccgaagggcggccctggcatgcgcgaaatgcttggcgtgacggcggccatcgccggcaccgaactcgccgagaccgtcgcgctcatcaccgacggacgtttctccggcgctacccgcggcttgagcgtgggccacgttgcgcccgaagccgcgaatggcggcgcgatcgctgtggtacgcaatggcgacatcatcactctcgacgtggaacgccgcgaactgcgcgtccacctcaccgacgcagaactcgaagcgcgcctccgcaactggcgcgcgccggagccacgatacaagcgcggcgtcttcgccaagtatgcgagcaccgtttcgtcggcgtcgttcggggccgttaccggctccaccatcgaaaacaagaccttagccgggagtacgaagtag

SEQ ID NO: 140 - protein, 573 aa, Acidobacteria bacterium
MTEKSPKPHKRSDAITEGPNRAPARAMLRAAGFTPEDLRKPIIGIANTWIEIGPCNLHLRELAEHIKQGVREAGGTPMEFNTVSISDGITMGSEGMKASLVSREVIADSIELVARGNLFDGLIALSGCDKTIPGTIMALERLDIPGLMLYGGSIAPGKFHAQKVTIQDVFEAVGTHARGKMSDADLEELEHNACPGAGACGGQFTANTMSMCGEFLGISPMGANSVPAMTVEKQQVARRCGHLVMELVRRDIRPSQIITRKAIENAIASVAASGGSTNAVLHLLAIAHEMDVELNIEDFDKISSRTPLLCELKPAGRFTATDLHDAGGIPLVAQRLLEANLLHADALTVTGKTIAEEAKQAKETPGQEVVRPLTDPIKATGGLMILKGNLASEGCVVKLVGHKKLFFEGPARVFESEEEAFAGVEDRTIQAGEVVVVRYEGPKGGPGMREMLGVTAAIAGTELAETVALITDGRFSGATRGLSVGHVAPEAANGGAIAVVRNGDIITLDVERRELRVHLTDAELEARLRNWRAPEPRYKRGVFAKYASTVSSASFGAVTGSTIENKTLAGSTK

SEQ ID NO: 141 - DNA, 1668 bp, Thermus thermophilus
atgaggtcggaccagatcaagaagggactcaagcaggcccccgcccgcgccatgctccgggcggtgggggtgggggacgaggacttcggaaggcccttcgtgggggtggtgaacaccttcaccgacgggatgccctgcaacttccacctgcgggagctggcccagcacctcaaggccgggctcagggaggcggggcttttcccctttgagttcggggcccccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggcacggccatgggggtgatccgcagcggcgtccccggcatggtcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgtggggggcagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccgtcgccgccgtggccgccacgggggggagcaccaacgccgtcctccacctcctcgccctggccaaggaggcgggggtggagctcagcctggacgactttgaccagatctcccgcaagaccccggtgatcgcggacctccgcccttggggcacctacaccgcctgggagctgtatgaagccggggggacggccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaaggggaacctcgcccctcaaggcgccgtcctcaagctcgcggggacggaacgcacctcctttgagggcccggcccgggtctttgactccgaggaggcggccatggagaaggtcctgaagggggagatccggcccggggacgtggtggtcatccgctacgtgggccccaagggggcgccggggatgcccgagatgctctcggtgacgagcgccatcgtgggggagggcctggggccggaggtggccctcctcaccgacggccgcttctccgggggcacccgcggcctcatgatcggccacatcgcccccgaggccttcgtgggcgggcccatcgccctcctggaagagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 142 - protein, 555 aa, Thermus thermophilus
MRSDQIKKGLKQAPARAMLRAVGVGDEDFGRPFVGVVNTFTDGMPCNFHLRELAQHLKAGLREAGLFPFEFGAPAISDGISMGTPGMRASLVSREVIADSVELIAQGYLYDGMVGLSACDKTIPGTAMGVIRSGVPGMVLYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAVAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPQGAVLKLAGTERTSFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 143 - DNA, 1725 bp, Maricaulis maris
atgacccacgacagacgcaaatcttcagacgccatcacagccggcgcggcccgcgccccggcccgggccatgttgcgcgcgaccggcatgacggatggtgatttcgacaagccgatgatcggggtgatcaacacctggaccacggtcacgccctgcaacatgcacctggcggacctggccgcgccagtccgcgaagccgttcgtgaagccggtggccatccggtcgacttcaacacgatcgtcgtgtccgacgggatctcgatgggtaccgaaggcatgcgtgcctcgctgatctcgcgcgaggtgatcaccgactcgattgaactggcgacccggggtcacagcctggatggcgtcgttatcctcgtcggttgtgacaagaccattccggcggccgcgatggcgctggcccgcatggatgtgcccggttgcatcctctacggcggcacgatcatgccgggcaagctgggcgatcaggccctgtccatccaggacgtgttcgaagctgtaggcgcccatgccgcggggaccctggatgatgcaggcctggacaaggtcgaaaaagcggcttgcccgggcgccggcgcctgtggcggccagtttaccgccaatacgatggccatgatcctgaccatgctgggtctgtctccgatgggcgtgaacgacattcccgccccgcaccccgacaagccggaggcggcggctcgctgcggccgactggctgtcgagctggcgaaatccggcaccaccccgcgccgtttcatcaccgaagcctcccttcgcaatgccgttgtcggcgcttccgcctcgggcgggtcgaccaatgccgtcctgcacgtcgccgcaatcgccgccgaagccggcataccgttcgacattgccgagttcgaccgtatctccagcgaagcccccgtcatcaccgacctgaagccgggcgggcgttttctggcccaccacatgttcctggccggcggctcccgcctgttcggtcagcgcctgatcgagggcggcttgctggctgataccccgactgtctccggcaagagcctgcatgaagagtgcgccagcgccgaagagtcactcaatcaacgtgtcatccaatccgttgccaacccggtcaaaccggatggtggtttccgcgtcctgaccggcgacctggcccccgaaggcgcagtcctgaaactgtcgggtcatgcccgcagcgaattttccggaccggcccgggtgttcgaatgcgaggaagacgccttcgccgccgtggaggccaactcggtcaaggctggtgacatcatcatcatccgcaatgagggccccaagggcggccccggaatgcgggaaatgctgggcgtgaccgccgccctggtcggtcagggactggccggcgatgtcgccctgatcaccgatggccgcttttccggcgcctccaagggcttcgtgatcggtcatgtcagccccgaggccgccgatggcggtccgatcggacgggtccgaaatggagacagggtgcgcattgatgtcgccgcccgccggatcgatgtcgatgccgacctgtctgcccgtccgcaatcctcgtccggccggcccgccccgaccggtgttttcgccaaatatgccgcgctggtctcttcggcctcgcgcggcgccaccaccatcatcgcgccgactgccaccaaggcgtcgccgcaaacaaccgacatgcaatccaagcaggagatgcccgcatga

SEQ ID NO: 144 - protein, 574 aa, Maricaulis maris
MTHDRRKSSDAITAGAARAPARAMLRATGMTDGDFDKPMIGVINTWTTVTPCNMHLADLAAPVREAVREAGGHPVDFNTIVVSDGISMGTEGMRASLISREVITDSIELATRGHSLDGVVILVGCDKTIPAAAMALARMDVPGCILYGGTIMPGKLGDQALSIQDVFEAVGAHAAGTLDDAGLDKVEKAACPGAGACGGQFTANTMAMILTMLGLSPMGVNDIPAPHPDKPEAAARCGRLAVELAKSGTTPRRFITEASLRNAVVGASASGGSTNAVLHVAAIAAEAGIPFDIAEFDRISSEAPVITDLKPGGRFLAHHMFLAGGSRLFGQRLIEGGLLADTPTVSGKSLHEECASAEESLNQRVIQSVANPVKPDGGFRVLTGDLAPEGAVLKLSGHARSEFSGPARVFECEEDAFAAVEANSVKAGDIIIIRNEGPKGGPGMREMLGVTAALVGQGLAGDVALITDGRFSGASKGFVIGHVSPEAADGGPIGRVRNGDRVRIDVAARRIDVDADLSARPQSSSGRPAPTGVFAKYAALVSSASRGATTIIAPTATKASPQTTDMQSKQEMPA

SEQ ID NO: 145 - DNA, 1662 bp, Parvularcula bermudensis
atgacccaaaacaaacgaagcgacgccatcaccaagggaccggcccgggccgctgcccgcgccatgctccgcgcgacgggcatgtcggacgccgatttcgacaagccgatggtggggatcatcaacacctacgcctcggtcactccctgcaatatgcatttgcgcgccctgggcgaagacgtccgcgccggtgtcgttgaggggggcggctggccggtcgagttcgggaccatcgtcgtctccgacggcattacgatgggccacgaagggatgcgggccagcctgatgtcgagggaggtgatcgccgactccatcgaactagccgtgcgcggccacgcgctcgatgcggccatcgtgctggtgggatgcgacaagaccattccggccgcagcgatggccctggcacgactcgatatccccgggatcgttttctacggcggcacgatcgcccccggctgtcacaaaggccaggatatcagcattcaggatgccttcgaagctgtcggcgcctatggccttggccggatcgatggcgacgaattgtcggcggtggaacgcgcggcttgccctggtgccggggcgtgcggtggccagttcacggcgaacactatggcgatggccatggcgtttctcggccttgcccccatgggcgccggcgaccccccggccctccatccggacaaaacgatcgaggctcggcgctgtggccaattggtggccgagaatgcccttggcaccaccgcccgcacctatgtctcgcccgagagcctccacaatgccgtctgtgccgttgtcgcctccggcggctccaccaatgcggtgctgcacctcgccgctatcgccgcggaggcgaaggtccccttctcgatcgatctgttcgaccagctttcgaggaccacgccggtgatcgcgaacctcaaaccgggggggcgttacctggcgcaggatctgttcgccgtcgggggcaatcgccggttcggcaaaatgctgatggaagcgggcgcgctgaaagatattcccacgacgagcggacgctctctctttgccgagttggccgaggcgccgccgagcgatgacaccgacgtgctgcgccctgtggacgcgccgctcaagcccaccggcgggctgcgcatcctctatggcgacgtggcgcccgacggcgccgtgctgaaaaccgccggctatggcgacggcgcctttgaggggccggcgcggatcttcgaatgtgaggaggattgcttcgcggcggttcaggccggcaccattgccgagggcgatgtcgtcgtgatccgcaatgaaggccccaaaggcggcccggggatgcgagagatgctcggcgtcacagcggccctcgccggacagggccttgcaggaaaggtcgccttgttgaccgacggccgattttcaggcgccagtcatggcttcgttatcggtcacatctcccccgaggcggcggtgggcggccccatcggcctgttgcaggagggcgaccggatttcgatcgacgccgaagggcggcgtatcgatgccgccatcgactggcaggcccgcaaagagaattataccccaaccccaaaggcgccccagggcggctatttcgacaaatatcgcgcgttggtcggctcggcgagccgcggcgccacaactctccaggaaggataa

SEQ ID NO: 146 - protein, 553 aa, Parvularcula bermudensis
MTQNKRSDAITKGPARAAARAMLRATGMSDADFDKPMVGIINTYASVTPCNMHLRALGEDVRAGVVEGGGWPVEFGTIVVSDGITMGHEGMRASLMSREVIADSIELAVRGHALDAAIVLVGCDKTIPAAAMALARLDIPGIVFYGGTIAPGCHKGQDISIQDAFEAVGAYGLGRIDGDELSAVERAACPGAGACGGQFTANTMAMAMAFLGLAPMGAGDPPALHPDKTIEARRCGQLVAENALGTTARTYVSPESLHNAVCAVVASGGSTNAVLHLAAIAAEAKVPFSIDLFDQLSRTTPVIANLKPGGRYLAQDLFAVGGNRRFGKMLMEAGALKDIPTTSGRSLFAELAEAPPSDDTDVLRPVDAPLKPTGGLRILYGDVAPDGAVLKTAGYGDGAFEGPARIFECEEDCFAAVQAGTIAEGDVVVIRNEGPKGGPGMREMLGVTAALAGQGLAGKVALLTDGRFSGASHGFVIGHISPEAAVGGPIGLLQEGDRISIDAEGRRIDAAIDWQARKENYTPTPKAPQGGYFDKYRALVGSASRGATTLQEG

SEQ ID NO: 147 - DNA, 1683 bp, Oceanicaulis alexandrii
atgaccgataacaaacgcccctcgcacacactgatccaggggccggcccgcgccccggctcgcgccatgcttcgcgcggccggctatgacgatgaccggatggcgaaacccatgatcgccatcgtcaacacctggaccagcgtcaccccgtgcaacatgcaccttcagggtctcgccgatcatgcccgcgccgggatcgaggcggcaggcggcacggcggtggatttcaacaccatcgtcgtcaccgacggcatctccatgggcaccgaaggcatgcgcgccagcctgatgagccgcgattgcgtggcggactccgccgaactcgccgtgcgcggccattgcctggacgccgtgctgttcctggtgggctgcgacaagaccctgcctggcgccgccatggcggcggcgcggctgaacctgcccagcgtcgtgctctatggcggctcgatcatgccgggcaagctgggcgacaaggcggtgacgattcaggacgtgttcgaggccgtcggggcctgcgcggcgggcaagatcagcgaagacgaactcgtcgaagtcgaaaaagccgcctgccccggcgcgggcgcctgcggcggccagttcaccgccaacaccatggcgctggcgctgaccgcgctcggcctgtcgcccatggggctcaacgacattcccgccgttcatcccgacaagcccgaagccgcgcgcaaggccggtcaggccgtggtcgatgcgctgaaggcggatcgcaagccgcgcgacatcatcaccccgacctctctgaaaaacgccgccgtcgcggtgaccgccacggcgggctccacaaacgcggtcctgcatcttctggccattgcccgcgaagccggggtcagccgggatcagttcgacattgatgtgtttgacgccgtgagccggaagactccggtgatcgccgatctcaagcccggcggtcgctatatggcgccggacatggcggctgcgggcggggcacgcctgctgctgcagcgcctgaaagccgcggacatgctggacgatgcgcccaccgtcaccggcaagaccctgtttgaagaagccgagctggccgctgaaacgccgggtcaggacgtgatcctgtcgcccgacaaaccgctcaagaagcgcggcggcttcggcgtgctttatggcgatctcgccccggaaggctgcgtcgccaagctcgcgggtcatgaccgtctgttctttgaaggccccgccaaggtatttgattgcgaggaagactgcttcgccgcggtcaattcgggcgggatcgagaagggcaatgtggtcgtcatccgcaatgaaggccccgccggcgggccgggcatgcgtgaaatgctggccgtcaccgccgccattcaaggcgcaggcctgggcgatgatgtggcgttgatgacggacggccgcttctcgggcgcgacctatggcttcatggtcgggcacgtcgcccccgaagccgcccatggcggacccatcgcctttgtgaagaccggcgatatcatcaccatcgatatcgagaaccgtcgcattgatgtgaaggccgatctcaaggcgcgcatggcccagggcttcaccccgcccgaacccaaataccgcacgggggcgttcgcgaaatacgccaggctcgtccactccgcatcagatggcgcggtgacgagcttcccgttcgactag

SEQ ID NO: 148 - protein, 560 aa, Oceanicaulis alexandrii
MTDNKRPSHTLIQGPARAPARAMLRAAGYDDDRMAKPMIAIVNTWTSVTPCNMHLQGLADHARAGIEAAGGTAVDFNTIVVTDGISMGTEGMRASLMSRDCVADSAELAVRGHCLDAVLFLVGCDKTLPGAAMAAARLNLPSVVLYGGSIMPGKLGDKAVTIQDVFEAVGACAAGKISEDELVEVEKAACPGAGACGGQFTANTMALALTALGLSPMGLNDIPAVHPDKPEAARKAGQAVVDALKADRKPRDIITPTSLKNAAVAVTATAGSTNAVLHLLAIAREAGVSRDQFDIDVFDAVSRKTPVIADLKPGGRYMAPDMAAAGGARLLLQRLKAADMLDDAPTVTGKTLFEEAELAAETPGQDVILSPDKPLKKRGGFGVLYGDLAPEGCVAKLAGHDRLFFEGPAKVFDCEEDCFAAVNSGGIEKGNVVVIRNEGPAGGPGMREMLAVTAAIQGAGLGDDVALMTDGRFSGATYGFMVGHVAPEAAHGGPIAFVKTGDIITIDIENRRIDVKADLKARMAQGFTPPEPKYRTGAFAKYARLVHSASDGAVTSFPFD

SEQ ID NO: 149 - DNA, 1605 bp, Plesiocystis pacifica
atgctgcgcgccacgggcctcgaagacgaggacctcgccaagccgctgatcgccgtggtcaacacctggagcgacgtgaccccctgcaacgtgcacctgcgcgggctcggggaggcggtccgccgcggggtccaagacgctggcggaacgcccttcgagttcaacaccatcgtcgtcagcgacggcatctccatgggcacggagggcatgcgggcgtcgctggtctcgcgggaggtcatcgccgacagcatcgagctcgccgtgcgcgggcacagcctggacgcggtcgtggtcatcgtgggctgcgacaagacgatcccggcggcggccatggccctcgcgcgcctcgatcgtccggggctggtcctctatggcggctcgatcgccaagggccggcaccggggggccgacgtcagcattcaggaggtcttcgaggccgtgggcgcctgcgcggccgggcgcatcgacgcggacgagctcgacgccatcgagcgcagcgcgtgcccgggcgcgggggcctgcgggggccagttcacggccaacaccatggcccaggtgctgaccttgctcgggctctcgcccctgggcgcgaacgacattccggccacgcacccggccaagctcgaggtcgccgaggcttgcgggcgtcaggtcctcgagctgctcgagcgcgagctccggccgagcagcttgctgaaccgggcggccttcgcccgggcgacggcgggggtggccgcgagcaagggctcgaccaacgccgtgctccacatcctcgccatcgcccgggaggccggctgcgacttctcgttgcgcgagctcgacgaggtctgcgcggcgacccccgtgctctgcgacctcaagccctcggggcgctacctggccgtcgacatgagcgaggccggcgggacggccctgctcgcccggcggctgttcgaggccgggctgtgcgaggacggggcgagcgtcgacgggccctcgctccgggccctggtcgccgacgcccccgagcgcgaggggcagcgggtgatccggccggcgagccaggccttcgcgccccggggcgggctcatggcgctgttcggcaacctggcgcccgagggctgcgtgctcaagctgccccccgagctccccgaggtgttcgagggggtcgccagggtgttcgacgacgaggactcggccttcgccgcggtgcaggccggcgccgtcgaggccggcgacgtcgtcgcgatccgctacgaggggccggccggcggcccgggcatgcgcgagatgttggcggtcacggctgccctcgtgggtcggggcctcggcgggcgcgtggcgttgatcaccgacgggcgcttttcgggggcgagccacgggctggtcatcggccacgtcgcccccgaggccgcccggggcggccccctggccaggctccgcgacggcgaccgcgtgcgcatcgacgtcgtcggccagcgcctcgacgtgctcgacgcggacttcgaggcccggcgaagcccggccgcgaaggcgcctcgctacctcaccggcgccctcgccaagttcgccgcgctggtcgactcggccagcgaaggcgccacgacttctcgtccgcagttttga

SEQ ID NO: 150 - protein, 534 aa, Plesiocystis pacifica
MLRATGLEDEDLAKPLIAVVNTWSDVTPCNVHLRGLGEAVRRGVQDAGGTPFEFNTIVVSDGISMGTEGMRASLVSREVIADSIELAVRGHSLDAVVVIVGCDKTIPAAAMALARLDRPGLVLYGGSIAKGRHRGADVSIQEVFEAVGACAAGRIDADELDAIERSACPGAGACGGQFTANTMAQVLTLLGLSPLGANDIPATHPAKLEVAEACGRQVLELLERELRPSSLLNRAAFARATAGVAASKGSTNAVLHILAIAREAGCDFSLRELDEVCAATPVLCDLKPSGRYLAVDMSEAGGTALLARRLFEAGLCEDGASVDGPSLRALVADAPEREGQRVIRPASQAFAPRGGLMALFGNLAPEGCVLKLPPELPEVFEGVARVFDDEDSAFAAVQAGAVEAGDVVAIRYEGPAGGPGMREMLAVTAALVGRGLGGRVALITDGRFSGASHGLVIGHVAPEAARGGPLARLRDGDRVRIDVVGQRLDVLDADFEARRSPAAKAPRYLTGALAKFAALVDSASEGATTSRPQF

SEQ ID NO: 151 - DNA, 1713 bp, Bacillus sp.
ttgggaagagatcttagaataaaaagccatgtaatcagcgaggatgaaaggcgcgcaccaaaccgggcgatgctgcgggcagtagggttcacggatgaagatttcaaaaagccgatgatcggcattgcaagcacatggagcgaagtgactccgtgcaatatacatatcaatgaacttgcattcaaggcgaaggacggtgccagggaagccgggggagctccgcttgtattcaatacgattactgtttctgacggaatctccatgggaacagaggggatgaggtattcccttccgagccgcgacctgattgctgattccattgaaacggtcgttgggggtgaaagcctggacggctttgttgccattggaggctgcgataaaaatatgcccggctgcctgatggccatcgcaaggatgaacctgcctgctgtttttgtgtatgggggcacaatcaagcctggcaagctgcagggacaggatatcgatattgtgtcagtatttgaaggggtaggacagttcaatggtggggccattgataaagctggactcaatgagatcgaatgccatgcatgtccgggggccggctcctgcggcggaatgtacacagccaatacgatggcaagcgctatcgaggcgctgggaatgagccttccgggcagttcctccaatccggcagaaacagatgaaaagcggcaggattgccatgaagcaggaaaggcagtctaccgccttttggagcaggatatcaggccaagggatattcttacgaaggaagcgtttgagaatgcaattactgtcgtgatggctttgggcggttcgacaaatgccatcctccatttgatggccatcgcccattctgctgaagtggatctgtcacttgaggacttcaaccgccttcagaaaacggtcccccatatagccgatttaaagccgagcggaaaatatgtcatgcagaatctccatgaagcaggaggagtcagtgcagttatgaaaatgctgctgagggaagggctgcttcacggcgattgtctgactgtgacgggcaagacgctcgctgaaaatctggaagaagcagaagatctgaaagctggccaaaaggtcatttacccgcttaatgcccctcttcgggaaaacgggccgcttgtagtcctgaaaggcaatcttgccccggaaggcgccgtagcgaaggtatccggcctgaaggtcaccaggcacaccgggcctgccaaggtgtttgatgatgaggagtctgctacagatgctgtcctgaagggtgacattcaggctggtgatgtactggttatcaggtacgaagggccaaaaggcgggcctggcatgccggaaatgctttctatttcgggcatcctcgtaggaaaaggtcttggcgaaagtgtggccctgctgacagacgggcgtttctcgggaggtacccatggccttgtggtaggacatatcgctccggaagcacaggtcggcggaccgattgccctaatacagacaggtgacaggattactattgacagcaccgaacagacacttgaagtggatgtctctcctgctgaactggaagagaggaagaaatcctgggatccgccgccgcttttaacccgcggagccctggctaagtatacaaggctcgtttcctccgcttcaaggggggctgtcactgaccattttgaggaagagcctgctgccaggccgcttaaagtgtag

SEQ ID NO: 152 - protein, 570 aa, Bacillus sp.
MGRDLRIKSHVISEDERRAPNRAMLRAVGFTDEDFKKPMIGIASTWSEVTPCNIHINELAFKAKDGAREAGGAPLVFNTITVSDGISMGTEGMRYSLPSRDLIADSIETVVGGESLDGFVAIGGCDKNMPGCLMAIARMNLPAVFVYGGTIKPGKLQGQDIDIVSVFEGVGQFNGGAIDKAGLNEIECHACPGAGSCGGMYTANTMASAIEALGMSLPGSSSNPAETDEKRQDCHEAGKAVYRLLEQDIRPRDILTKEAFENAITVVMALGGSTNAILHLMAIAHSAEVDLSLEDFNRLQKTVPHIADLKPSGKYVMQNLHEAGGVSAVMKMLLREGLLHGDCLTVTGKTLAENLEEAEDLKAGQKVIYPLNAPLRENGPLVVLKGNLAPEGAVAKVSGLKVTRHTGPAKVFDDEESATDAVLKGDIQAGDVLVIRYEGPKGGPGMPEMLSISGILVGKGLGESVALLTDGRFSGGTHGLVVGHIAPEAQVGGPIALIQTGDRITIDSTEQTLEVDVSPAELEERKKSWDPPPLLTRGALAKYTRLVSSASRGAVTDHFEEEPAARPLKV

SEQ ID NO: 153 - DNA, 1686 bp, Oceanobacillus iheyensis
atgggaaaagatttgcggataaaaagtaaagcatttgacggtactatgcgagctccaaatagggcaatgcttcgtgcggtcggtctgacagatgaagattttaagaagcctatgattggtgtagcaagtacatgggcagaagtaacaccatgtaatatacatttaaatgatttagctcttcttgccaaaaaaggggtccggcactcggatgctgttcctttggtctttaatacgataaccgtatctgatggaatttccatgggaacacaaggtatgaactactcattgccgagtcgagatcttattgctgattcaatcgaaaccgttgttggagcagaaaatttagatggattagtagcaattggagcctgtgacaagaatattccagggtgcttgattgcgattgctaatgcaggagttccctcggtatttgtatatggcggaacaattgccccaggaaatgtggatgggaaagatatagatattgtttcagttttcgaaggagtaggacaacataatgcaggagctattgacgataatcaattaagaaaagtagaatgtaatgcttgtccaggtgcaggagcatgtggtggaatgtataccgccaatacaatggcctctgcagcggaagctttaggaatcagtttaccgggaagctcttctaacccagctgaatcagaagaaaagcagggtgatgtggaggcagctggtgaagcgattaaagatttattagagaaaggtatttatccaaaagatattctaacgaaaaaagcttttgaaaatgcaattacagtagttatggcattgggaggatctacaaatgcgatcttgcatttactagcagtttctcatgccgcagaagtagacttaacgattgatgattttaatcgaatccagaaaaaagtaccgcatttagccgatttaaaaccaagtggacgttttgtaatgcaagaccttcatcgagttggtggggtacaagcagtaatgaaattattgcatgaaaatggatacttacatggcgactgtcttactgtaacaggaaagactatagcagaaaatctagctgaagctcctgctttgaaagaaaatcaacaagtcattatgccgtttgataatccaaaaagggaagatggtcctctgattgtcttaaaggggaatttatcaccaactggtgctgtggcaaaagtatcaggggtgaaagtgaaacgacacacaggtcctgcacgtgtattcaacacagaaaaagaggcaactcaagcaattctggataacaaaattaaagagggagatgtattagttattcgttatgttggaccaaaaggtggtcccggaatgccggagatgttgtctgtttctagtattcttgtaggtaaaggaatgggagaatcggtagctttattgacggatggtagattctctggtggtacacatggtcttgtggtaggtcatataagtccagaggcacaagatggcggaccaattgcatttctgcaagaaggagatatggtgaccatagattctaataaaagagaaatttccatggacgtttcggaagatgaaataaaactacgtcaaggaaaatgggaagcccctgaactacataagaaaggggttcttggaaaatatgcacataatgttacttgctcatccaaaggtgcagtaacagattatttgaaccgagaataa

SEQ ID NO: 154 - protein, 561 aa, Oceanobacillus iheyensis
MGKDLRIKSKAFDGTMRAPNRAMLRAVGLTDEDFKKPMIGVASTWAEVTPCNIHLNDLALLAKKGVRHSDAVPLVFNTITVSDGISMGTQGMNYSLPSRDLIADSIETVVGAENLDGLVAIGACDKNIPGCLIAIANAGVPSVFVYGGTIAPGNVDGKDIDIVSVFEGVGQHNAGAIDDNQLRKVECNACPGAGACGGMYTANTMASAAEALGISLPGSSSNPAESEEKQGDVEAAGEAIKDLLEKGIYPKDILTKKAFENAITVVMALGGSTNAILHLLAVSHAAEVDLTIDDFNRIQKKVPHLADLKPSGRFVMQDLHRVGGVQAVMKLLHENGYLHGDCLTVTGKTIAENLAEAPALKENQQVIMPFDNPKREDGPLIVLKGNLSPTGAVAKVSGVKVKRHTGPARVFNTEKEATQAILDNKIKEGDVLVIRYVGPKGGPGMPEMLSVSSILVGKGMGESVALLTDGRFSGGTHGLVVGHISPEAQDGGPIAFLQEGDMVTIDSNKREISMDVSEDEIKLRQGKWEAPELHKKGVLGKYAHNVTCSSKGAVTDYLNRE

SEQ ID NO: 155 - DNA, 1695 bp, Staphylococcus saprophyticus
ttgactaaagaacacagcgaacaacaaaaagatttacgtattcgcagcaaagtaattagtgaaggtgtcagtcgtacacccaatcgagcttatttacgggcactcggctttgaagatgaagattttcaaaaaccaatgattggtgttgcaagtacttggagtgaagtcacgccatgtaatatgcatattgatggtttagctcgtgcttcaaaacaaggcattagtgaggcaggtgcttcgccacttattttcaataccattacagtatcagatggtatttcaatgggaacagacggtatgcgcttctctttaccaagtcgtgaaattatcgcggattctatagaatcagttgtcagtgctgaaaatttagatgcacttgtcgctattggtggttgtgacaaaaacatgccgggatgtatgattggtatcgctcgtcttaatttaccagctgtctttgtttatggcggcacaatattgcctgggaaattggatggtaaagatttagatgctgtttctgcctttgaaggcgtcggacagtataataatggcgaaatagataaagaggcacttcacaaagtagaatgtgccgcttgtccaggggccggtgcttgtggtggtatgttcactgccaatacgatgtcatctgctattgaggccatgggcatgagtttaccaggaagtgcttcgcatccagcagtttctacaaataaatccaaagacagcagagcagcaggtaaagccgtttataaactattagaaaaaggcatctatccaaaagatattatgactaaagaagcatttgaaaatgcaattactgtagtcatggcacttggaggatctaccaatgcaattttacatttacttgctattgcacatacaatcgaagtcgatttaacacttgatgatttcgaaaaaattcgtaagcgtgtcccacatatcgctgacttgagaccaagtggtaaatatgtcatggcacatcttgatgaagtcggtggtattccagcagttatgaaattattacatgacaaaggcttaatccatggagattgcttgaccgtaactggcaagactgttgctgaaaaccttgaacaacaacctgacctaaccgataataaatctatcattgattttgacaatccaaaacatgctactggaccgcttgttatcttgaaaggaaatcttgccccagaaggcgccgttgcaaaaatctcaggtctgagcgtaacttatatcaaaggacccgcacgcgtatttgattccgaatctaaggctaccaaagccatcttaaatgacgaaatcaaaccaggtgacgtggtcgttattcgatatgctggccctaaaggtgcacctggcatgcctgaaatgctatctgcatcatccattcttgtgggtaagggattaggtgaatctgtagcgttactcacagatggccgtttctctggcggttctcatggtcttgttatcggacacgcagcgccagaatcacaagttggcggtccgatggcattattagaagaaaacgacacgattaccattgacgcagaaaaacttgaaattagttttgatgtatcagacgaagaacttgagcgtcgtaacaaacaatggcaagcaccacctttaaaagccaatcgaggtacgctagctaagtatgctaagcttgtgtcatccgcttcaaaaggagctatcacagactaa

SEQ ID NO: 156 - protein, 564 aa, Staphylococcus saprophyticus
MTKEHSEQQKDLRIRSKVISEGVSRTPNRAYLRALGFEDEDFQKPMIGVASTWSEVTPCNMHIDGLARASKQGISEAGASPLIFNTITVSDGISMGTDGMRFSLPSREIIADSIESVVSAENLDALVAIGGCDKNMPGCMIGIARLNLPAVFVYGGTILPGKLDGKDLDAVSAFEGVGQYNNGEIDKEALHKVECAACPGAGACGGMFTANTMSSAIEAMGMSLPGSASHPAVSTNKSKDSRAAGKAVYKLLEKGIYPKDIMTKEAFENAITVVMALGGSTNAILHLLAIAHTIEVDLTLDDFEKIRKRVPHIADLRPSGKYVMAHLDEVGGIPAVMKLLHDKGLIHGDCLTVTGKTVAENLEQQPDLTDNKSIIDFDNPKHATGPLVILKGNLAPEGAVAKISGLSVTYIKGPARVFDSESKATKAILNDEIKPGDVVVIRYAGPKGAPGMPEMLSASSILVGKGLGESVALLTDGRFSGGSHGLVIGHAAPESQVGGPMALLEENDTITIDAEKLEISFDVSDEELERRNKQWQAPPLKANRGTLAKYAKLVSSASKGAITD

SEQ ID NO: 157 - DNA, 1752 bp, Bacillus selenitireducens
atgatagacgttatatggcatgtgagattatgtacattgacagaaagggtgaatgttgtgagtgagaaggatttgcgtcataaaagtaaagtgatcagtgaaggggtaaaccgggttccgaaccggtcaatgctgcgtgcagtcgggtttaccgatgaggatttcaagaaaccgatgattggggttgcgagtacgtggagtgaggtcaccccttgtaatgtacatattgatgccttggcaagagatgccaagctcggagcggcagaaggcggcggagcgccgatgatcttcaatacgatcatggtcgctgacgggattgcgatggggcatgaaggcatgagctattccctgccgtcaagggaagtcatcgccgattccattgaaacggttgtcggagcagaagccctcgacgccgtcgtcgccattggcggttgtgacaaaacaacgccgggctgtctcatttccatgggacggatgaatgtaccgggcgtctatgtgtatggcggtacgatcaaaccggggaaactcgatggcaaggacatcgacatcgtcaactccttcgaggcagtcggtcagtaccagagcggcaagcttgatgaggaaggccttcataaagtggaatgttctgcctgccctggaccgggttcctgcggcgggatgtacacggcaaatacaatggccgcagcggcagaagcgctcggcatgagtattccaggctcatcatcgacgcctgcagtggatgattataagcatcaggagtgcaggcaggccggcgatctgacggttcagcttttggaaaaagacatcaagccccgtgatattatgacgaagaaggcgtttgagaatgccattaccgtcgtcatggccctcggcggctcaacaaatgccttcctgcatcttcttgcgattgcgagaagcgttgacgtcgacttgacgtatgatgactttgaacgggtccgcaagaacgtcccgcatattgccgatctgaagccaagcggtcagtatgtcatggaagacctcttccaggcagggggcgtgcctggcgtgatgaagctgcttcttgaagccggcctcctacatggcgactgcatgacggtaactggcaagacgattgccgagaaccttgcagctgcggaaccgctgaaagaaggacaaaaagtgatttttccgcttgataagccgattaagccaagcggtccattgattgtcatgaaagggaatctggcccctgaaggcggggttgccaagatgagcggtcagtcgatcagtcattttgaaggtacgatcaaagtgtatgacagtgaggccgatgcgacgaaggccattgaagcgggagagatcgttgagggggatgtcctcgtcatccgctatgtgggtccaaaaggcggtccgggtatgccggagatgctctcgatcacggcgatgatcgtaggtcgaggcttgaacggtaaagtcgcactgatgacagatggccgattctccggcggttcacacggctttgttatcggtcatattgcaccggaagccgcagtaggcgggccgattgcgctgatcaagaatggtgacaaggtcacgatcgatgcggatacgcaggagatcaatctgcatattgatgaagcggagtttgagaagcggaaacaggaatggcagccgaagccgccgcggtttacgtacggcgtgttgaagaaatatgccaaactcgtttcgtcttcagcggaaggcgcaattacagacggtaaagaagccgattga

SEQ ID NO: 158 - protein, 583 aa, Bacillus selenitireducens
MIDVIWHVRLCTLTERVNVVSEKDLRHKSKVISEGVNRVPNRSMLRAVGFTDEDFKKPMIGVASTWSEVTPCNVHIDALARDAKLGAAEGGGAPMIFNTIMVADGIAMGHEGMSYSLPSREVIADSIETVVGAEALDAVVAIGGCDKTTPGCLISMGRMNVPGVYVYGGTIKPGKLDGKDIDIVNSFEAVGQYQSGKLDEEGLHKVECSACPGPGSCGGMYTANTMAAAAEALGMSIPGSSSTPAVDDYKHQECRQAGDLTVQLLEKDIKPRDIMTKKAFENAITVVMALGGSTNAFLHLLAIARSVDVDLTYDDFERVRKNVPHIADLKPSGQYVMEDLFQAGGVPGVMKLLLEAGLLHGDCMTVTGKTIAENLAAAEPLKEGQKVIFPLDKPIKPSGPLIVMKGNLAPEGGVAKMSGQSISHFEGTIKVYDSEADATKAIEAGEIVEGDVLVIRYVGPKGGPGMPEMLSITAMIVGRGLNGKVALMTDGRFSGGSHGFVIGHIAPEAAVGGPIALIKNGDKVTIDADTQEINLHIDEAEFEKRKQEWQPKPPRFTYGVLKKYAKLVSSSAEGAITDGKEAD

SEQ ID NO: 159 - DNA, 1704 bp, Streptococcus pneumoniae
atgactgaattagataaacgtcaccgcagtagcatttatgacagcatggttaaatcacctaaccgtgctatgcttcgtgcgactggtatgacagataaggactttgaaacaccgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcagacgggatcgctatgggaacgcctggtatgcgtttctctctaacatctcgtgacatcatcgcggactccatcgaggcggctatgagtggtcacaacgtggatgcctttgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggctgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccatatcgtatcatctgcttcacgcggagccgtgacagacttctggaatatggacaagtcaggtaaaaaataa

SEQ ID NO: 160 - protein, 567 aa, Streptococcus pneumoniae
MTELDKRHRSSIYDSMVKSPNRAMLRATGMTDKDFETPIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 161 - DNA, 1719 bp, Streptococcus sanguinis
atgaaagggaaagctatgacagataaggatattcgtcacagaagtaagatttatgacagtatggttaaatctcctaaccgtgccatgcttcgcgcgacggggatgactgataaagattttgaaacgcctattgttggggtgatttccacttgggcggaaaatacaccctgtaacatccatttgcatgacttgggcaagctagccaaggaaggtatcaaagcagagggcgcttggcctgttcagtacgggactattacggttgcggacggaattgccatgggaacgccgggtatgcgcttctctctgacctcacgcgatatcatcgcagactccatcgaggctgccatgggcgggcataatgtggatgctttcgtagctatcgggggctgtgataaaaatatgccaggctccatgattgccattgccaatatggatattcctgctgtctttgcctacggcggaacgattgcgccagggaagctggacggtaaggacattgacttggtttctgtctttgaaggaatcgggaaatggaaccatggtgatttgacggctgaggaagtacgacgcattgagtgtaatgcctgccctggccctggtggctgtggtggtatgtatacggccaatactatggcgacggctattgaagttctgggtatgagcctgccaggctcctcttctcaccctgctgagtctaaagacaagcaagaggatatcgaagcagctggtcgtgctgttgtgaaaatgctgaaaatggggctgaagccgtctgacatcttgacacgtgaagcctttgaagatgcaatcacggtgaccatggctctgggtggttctactaatgctaccctgcacttgctggccatggcgcacgcggccaatgttgagctgacgcttgatgactttaatgtcattcaagagaaggtaccgcatttggctgacttgaaaccatctggtcagtatgtcttccaagacctttatgaggttggtggggtaccggctgtgatgaaatatctcttggcgaacggcttcctgcatggtgatcgcatcacttgtacaggtaagactgttgcagagaatctggtagaatttgctgatctgacaccaggtcaaaaggtcattatgccgcttgaaaatccaaaacgtgcggacggtccgctcattatcttgcatggtaatctggctccagatggtgctgttgccaaggtttctggtgttaaagtgcgccgtcacgttggaccggctaaggtctttgactcagaagaagcagctattgatgctgtactggccgatgaagtggtcgatggcgatgtggtcgtggttcgctatgttggaccaaagggtggccctggtatgccagaaatgctgtcactttcttctatcatcgtagggaaaggtcaaggggacaaggtggcacttctaactgacggccgcttctcaggcggtacttacggcttggttgtcggacacattgctccggaagctcaggatggtggcccgattgcctatcttcgtacaggcgatatggtcacggttgaccaagataccaaggaaatctctatggcagtctctgacgaagagctggcgaaacgtaaggcagaaacgactattccaccgctttatagtcgcggggtacttggtaaatatgctcacatggtatcgtctgccgctaaaggtgctgttactgacttctggaaaccagaagaaacaggtaagaaatag

SEQ ID NO: 162 - protein, 572 aa, Streptococcus sanguinis
MKGKAMTDKDIRHRSKIYDSMVKSPNRAMLRATGMTDKDFETPIVGVISTWAENTPCNIHLHDLGKLAKEGIKAEGAWPVQYGTITVADGIAMGTPGMRFSLTSRDIIADSIEAAMGGHNVDAFVAIGGCDKNMPGSMIAIANMDIPAVFAYGGTIAPGKLDGKDIDLVSVFEGIGKWNHGDLTAEEVRRIECNACPGPGGCGGMYTANTMATAIEVLGMSLPGSSSHPAESKDKQEDIEAAGRAVVKMLKMGLKPSDILTREAFEDAITVTMALGGSTNATLHLLAMAHAANVELTLDDFNVIQEKVPHLADLKPSGQYVFQDLYEVGGVPAVMKYLLANGFLHGDRITCTGKTVAENLVEFADLTPGQKVIMPLENPKRADGPLIILHGNLAPDGAVAKVSGVKVRRHVGPAKVFDSEEAAIDAVLADEVVDGDVVVVRYVGPKGGPGMPEMLSLSSIIVGKGQGDKVALLTDGRFSGGTYGLVVGHIAPEAQDGGPIAYLRTGDMVTVDQDTKEISMAVSDEELAKRKAETTIPPLYSRGVLGKYAHMVSSAAKGAVTDFWKPEETGKK

SEQ ID NO: 163 - DNA, 1719 bp, Streptococcus thermophilus
atggaggaaaacatcgtgtctgaaaataacatgaaacaccgttcttctgtctacgatagcatggttaaatcacctaaccgtgctatgcttcgtgcgactgggatgacggatgatagttttgaaaagcctattgttggggttatctcaacttgggctgagaacacgccatgtaatatccacttgcacggttttggtcaaattgccaaagagggtgtcaaagatgcgggtgcttggccagttcaatttggtacaattaccgttgcagatggtattgccatggggacaccagggatgcgtttctcattgacatctcgtgatattattgctgactcaatcgaagctgctatgggtggtcacaatgtcgatgcctttgttgctattggtggctgtgataagaacatgccaggttcaatgattgctattgccaacatggatattccagctatttttgcttacggtggtacgattgcaccgggtaatcttaacggtaaggatatcgacttggtttctgttttcgaaggtatcggtaaatggaaccacggagatatgactgccgaagaggttaaaaatcttgaatgtaatgcttgccctggccctggtggttgtggtggtatgtatactgctaacacaatggcaacagcaattgaggttatggggatgagccttccaggatcatcatctcaccctgcagaatcagctgagaagaaggctgatatcgaagaagcaggtcgtgcagttgtaaaaatgctagaaatgggacttaagccatcagatatcttgacacgtgaagcctttgaagatgccatcacagttacaatggcgcttggtggttcaacaaatgccactcttcacttgcttgctatcgctcatgcggctaacgttgatttaacgcttgaagacttcaacgatttccaagagcgcgtgcctcacttggctgacttgaagccttcaggtcaatatgtcttccaagacctttacaatgttggtggtgtgccagccgttatgaaatatcttcttaagaatggttttcttcacggtgatcgtatcacgtgtactggtaagactgttgcagaaaatttggaagctttcgatgatttgacaccaggtcaaaaagttatcatgccacttgaaaatcctaaacgtgccgatggtccattgattatcttgaaaggtaacttggccccagaaggtgctgttgccaaagtatcaggtgttaaagtgcgtaacattactggtcctgctaaagtatttgactcagaagaagatgccatcgaggcagttctttctgacgaaatcgttgacggcgatgtagttgttgtacgttttgtaggtcctaagggtggtcctggtatgccagaaatgttgtcattgtcatcaatgattgttggtaaaggacaaggagacaaggttgccctcttgactgatggacgtttctcaggtggtacttacggacttgttgtaggtcatattgctcctgaagctcaagttggtggaccgattgcctacctccgtacaggtgatatggttacagttgaccaggataccaaagaaatcactatgcatgtaccagacgaagagttggcgaaacgtaaagcagaaactgagttaccaccactttatagccgtggtgtcctcggtaagtatgctcacatcgtttcatcagcatcacgtggtgcggttactgacttctggaatatggataaatcaggtaaagcttaa

SEQ ID NO: 164 - protein, 572 aa, Streptococcus thermophilus
MEENIVSENNMKHRSSVYDSMVKSPNRAMLRATGMTDDSFEKPIVGVISTWAENTPCNIHLHGFGQIAKEGVKDAGAWPVQFGTITVADGIAMGTPGMRFSLTSRDIIADSIEAAMGGHNVDAFVAIGGCDKNMPGSMIAIANMDIPAIFAYGGTIAPGNLNGKDIDLVSVFEGIGKWNHGDMTAEEVKNLECNACPGPGGCGGMYTANTMATAIEVMGMSLPGSSSHPAESAEKKADIEEAGRAVVKMLEMGLKPSDILTREAFEDAITVTMALGGSTNATLHLLAIAHAANVDLTLEDFNDFQERVPHLADLKPSGQYVFQDLYNVGGVPAVMKYLLKNGFLHGDRITCTGKTVAENLEAFDDLTPGQKVIMPLENPKRADGPLIILKGNLAPEGAVAKVSGVKVRNITGPAKVFDSEEDAIEAVLSDEIVDGDVVVVRFVGPKGGPGMPEMLSLSSMIVGKGQGDKVALLTDGRFSGGTYGLVVGHIAPEAQVGGPIAYLRTGDMVTVDQDTKEITMHVPDEELAKRKAETELPPLYSRGVLGKYAHIVSSASRGAVTDFWNMDKSGKA

SEQ ID NO: 165 - DNA, 1716 bp, Streptococcus suis
atgaccgatacaaacaaacttaaagactttcgacatcgcagctctgtttacgattcgatggtcaaatcgcccaaccgtgctatgttaagagcaacaggaatgaccgacgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggtatgcgcttctccttgacttcacgtgatatcattgcagattctattgaggcagctatgggagggcacaacgtggatgcctttgtcgcaatcggtggctgtgataaaaacatgcctggttctatgattgctatcgccaatatggatatccctgctgtttttgcctacggcggaaccattgcgccaggtaatctcaatggtaaagacatcgacttggtatccgtttttgaaggaatcggaaaatggaacaacggtgacttgaccgctgaagaggttcgtcaaatcgagtgtaacgcttgccctggacctggtggttgcggtggtatgtacactgccaataccatggcgacagccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataa

SEQ ID NO: 166 - protein, 571 aa, Streptococcus suis
MTDTNKLKDFRHRSSVYDSMVKSPNRAMLRATGMTDDSFEKPIVGVISTWAENTPCNIHLHDFGKLAKEGVKEAGAWPVQYGTITVADGIAMGTPGMRFSLTSRDIIADSIEAAMGGHNVDAFVAIGGCDKNMPGSMIAIANMDIPAVFAYGGTIAPGNLNGKDIDLVSVFEGIGKWNNGDLTAEEVRQIECNACPGPGGCGGMYTANTMATAIEVMGMSIPGSSSHPAESPEKKADIEEAGRAVVRMLELGIKPSDIMTREAFEDAITVTMALGGSTNATLHLLAIAHAANVDLTLEDFNDFQERVPHLADLKPSGKYVFQDLYNVGGVPAVMKYLLKNGFLHGDRITCTGKTVAENLKNFADLTPGQDVIMPLENPKRADGPLIILKGNLAPEGAVAKVSGVKVRNHTGPAKVFDSEEEAIEAVLTDEIVDGDVVVVRYVGPKGGPGMPEMLSLSSMIVGKGQGDKVALLTDGRFSGGTYGLVVGHIAPEAQDGGPIAYLRTGDLVTVDQDTKEITMHVSDQEIEERKKTTVIPPLYSRGVLGKYAHTVSSASKGAVTDFWRPERTGKK

SEQ ID NO: 167 - DNA, 1716 bp, Streptococcus mutans UA159
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 168 - protein, 571 aa, Streptococcus mutans UA159
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 169 - DNA, 1683 bp, Leptospira borgpetersenii
atgagcgatatattaaaaaaaagaagttcgatgactacggacggagataaccgcgcgcccaatcgagcgatgcttcgcgcggtcggctttacggacgaagatttccacaaacctatgatcggaatcgcttccacatggagcgaagtgacgccttgtaatattcatatcaataagttggccgaaaaagtcaaagagggcgttcgtacggcgggaggagttcctcaaatttacggaaccatcacggtttccgacggaattacgatgggtcacgaagggatgcatttttcacttccctccagagaagtgattgcggattcaatcgaaatcgtttccaacgcgatgagacacgacggagtgatcgcgatcggaggttgtgataagaacatgcccggatgtctcatggctctttgcagaatcgatgctccttctattttcgtttacggggggaccattcttccggggcattgcgacggtcaagacgtggatatcgtttccatcttcgaagctgttggtaaatttaatgcaggtaaaatttcaagagaagaattcattcgaatcgagcagaacgcgtgtcccggcgcaggaagttgcggggggatgtataccgcaaatacgatgtcctccgcgatagaagctcttgggatgagtctgccaggttcggcttccatgcccgcggtgagttctagaaaatcggaggattgttacgaggcgggaaaagctctcatcaatctcattcaaaagggagtcactccgaagcgaattcttaccaaaaaagcttttgagaacgcgatcaccgtagtgcttgtgttaggcggttcaaccaatgcggtccttcatttgattgcgatcgcgaaagagattggtgtggatcttactctcgaagactttgatcgaatcagtaaaaaaactcctcaccttgcggatttgaaaccgggtggtagatacgccatgaccgatctcgacaaagtgggcggggttcatggtgtgatgaagtatcttttgaaagaaggaatgcttcatggtgattgtcttacggttacgggaaaaacaattgcagaaaatctaatggatatgcccgatctcgttccaaaccagacgatcgtccgtaaaaaatcggaggcgctccatccttccggtcctcttgtgattttgaaaggaaaccttgccccggaaggtgcggttgctaaaatttccggtttgaagaaaatttccatcacgggcccggcgaaagtgttcgaatccgaagacgattgtttcaatgcgatcatgacggatcaaattaaaccgggcgacgtgattatcattcgttacgaaggtcccaaaggtggtcccgggatgagagagatgctcgcggtaacttcggcgcttgtcggaaaaggtttgggagaagacgtgggtctgatgacagacggtcgattcagtggaggaacgcacggtctcgtagtcggtcatatttctcccgaagcatttgatggaggtccgattgcgatcgttcaaaatggggatgcggttactatcgattccggtaaaaatttgctccaagttgaaatttctcaggaagaaattcagaaacggctaaaaaattggaaaccgattgaaccgagatataaatccggggttcttgcgaaatacgcaaaactggttcaatcggcgactaacggagcgattacgaatctgctttga

SEQ ID NO: 170 - protein, 560 aa, Leptospira borgpetersenii
MSDILKKRSSMTTDGDNRAPNRAMLRAVGFTDEDFHKPMIGIASTWSEVTPCNIHINKLAEKVKEGVRTAGGVPQIYGTITVSDGITMGHEGMHFSLPSREVIADSIEIVSNAMRHDGVIAIGGCDKNMPGCLMALCRIDAPSIFVYGGTILPGHCDGQDVDIVSIFEAVGKFNAGKISREEFIRIEQNACPGAGSCGGMYTANTMSSAIEALGMSLPGSASMPAVSSRKSEDCYEAGKALINLIQKGVTPKRILTKKAFENAITVVLVLGGSTNAVLHLIAIAKEIGVDLTLEDFDRISKKTPHLADLKPGGRYAMTDLDKVGGVHGVMKYLLKEGMLHGDCLTVTGKTIAENLMDMPDLVPNQTIVRKKSEALHPSGPLVILKGNLAPEGAVAKISGLKKISITGPAKVFESEDDCFNAIMTDQIKPGDVIIIRYEGPKGGPGMREMLAVTSALVGKGLGEDVGLMTDGRFSGGTHGLVVGHISPEAFDGGPIAIVQNGDAVTIDSGKNLLQVEISQEEIQKRLKNWKPIEPRYKSGVLAKYAKLVQSATNGAITNLL

SEQ ID NO: 171 - DNA, 1665 bp, Candidatus Vesicomyosocius okutanii
atgtgcatcccaagaaaatattcctcacaagttgttgatggatttgaacgcgcaccaagtcgtgctatgctttaccccattggttttaaaaaagatgattttagcaaaccccaggttggtatagcaagcacttggtcaatggtaacaccatgtaatatgcatattaataaattagctgataaagccgaaaaagggataaataacgcaggtggtaaaggtgttatctttaacaccattaccatatcagatggtatttctatgggctctgaaggtatgaaatattccttagtatcacgcgaagtcattgccgattcaattgaaacagttgttggttgtcaagggtttgatggtgtggttgctattggtgggtgtgataaaaatatgcctggttgtattattggcttagcacgtcttaatcgccctagtatttttgtttatggcggtactattcaaccgggtaaaaatcgtacagatgtggtaagtgttttcgaagcagttggccgattttctaaccatgaaattgatgaaatagaactagaaaatattgaaaaaacagccgttactggagcaggttcttgtggtggtatgtacactgctaatactatggcatcagcaattgaagcattaggtatgagtttacccaactccagcgcacaaaatgctatatcagatgataaaaataatgattgtatccaagctggagaagctattcttactttattaaataaagacattaaaccccgtgatataatgactatgaaagcattcgaaaatgccatcactgtaattattgcattgggtggctcaaccaatgctgtattgcatttaattgccatggcaaatgccgctgaggttaatctcaaaattgatgattttactcgcattggtaaaaaagtacctgttattgctgaccttaaaccatcaggtaaatatatgatgagtgaattggttgaaattgggggtacattaccactaatgaaaatgctacttgatgcaggactattacatggggattgcatgacagtaacaggaaaaactttagctaaaaatttaaaaaatgttcaatcatatgctgattcccaagaaattattagagcattagataacccaataaagaaagattcacaccttagaattttgcgtggtaaccttgcaattaatggtgctgtggcaaagattactggtaaagaaggttcaagtttcaaaggtacagctaaatgtttttctcatgaagaaggagcgcttaaggctattttaaatgaccaaataaaagcaggtaatgttatcgttattcgttacgaggggcctgttggtggtcctggtatgcgtgaaatgcttgctcctacttctgcagttatggggaaaggattgggtggtaaaattgcacttattactgatgggcgcttctctggtggtacacatggttttgtagtcgggcatatcactcctgaagcctttaaaggtggagtgctagcagtggttgaagatggtgatgaaattataattgatgcacaaaataacgttttagaactattagttgatcaagctattattgataaacgcttatctaaatggacgcaacctaaaccaaactacactaaaggtgtattagcaaaatttgcaaaactagctaaatctgcttctgaaggtgcagttactgattaa

SEQ ID NO: 172 - protein, 554 aa, Candidatus Vesicomyosocius okutanii
MCIPRKYSSQVVDGFERAPSRAMLYPIGFKKDDFSKPQVGIASTWSMVTPCNMHINKLADKAEKGINNAGGKGVIFNTITISDGISMGSEGMKYSLVSREVIADSIETVVGCQGFDGVVAIGGCDKNMPGCIIGLARLNRPSIFVYGGTIQPGKNRTDVVSVFEAVGRFSNHEIDEIELENIEKTAVTGAGSCGGMYTANTMASAIEALGMSLPNSSAQNAISDDKNNDCIQAGEAILTLLNKDIKPRDIMTMKAFENAITVIIALGGSTNAVLHLIAMANAAEVNLKIDDFTRIGKKVPVIADLKPSGKYMMSELVEIGGTLPLMKMLLDAGLLHGDCMTVTGKTLAKNLKNVQSYADSQEIIRALDNPIKKDSHLRILRGNLAINGAVAKITGKEGSSFKGTAKCFSHEEGALKAILNDQIKAGNVIVIRYEGPVGGPGMREMLAPTSAVMGKGLGGKIALITDGRFSGGTHGFVVGHITPEAFKGGVLAVVEDGDEIIIDAQNNVLELLVDQAIIDKRLSKWTQPKPNYTKGVLAKFAKLAKSASEGAVTD

SEQ ID NO: 173 - DNA, 1680 bp, Candidatus Ruthia magnifica
atgcgaagaaaaattatgtacaacccaagaaaatactcctcacaagttgttgacggatttgaacgcgcgccaagtcgtgccatgctttatccagttggatttacaaaagaggattttaacaagcctcaagtcggcatagcaagcacttggtcaatggtaacaccgtgtaatatgcacattaataaattggctgatgagacattaaaaggggtaaatgccacaggtggtaaagccattatttttaacactattactatttcagatggtatttctatgggctctgaaggcatgaagtactctttagtctcacgtgaagttattgccgattcaattgaaactgtggttggttgtcaaggttttgatggtgtggttgcaattggtggttgcgataaaaacatgcctggttgtattattggtttggtacgtcttaatcgccctagtatttttgtttatggaggcacaatccagccgggtaaaaatcatacagatgtggtgagtgtttttgaagcagttggccaatttgccaatcatacaattgatgcgattgaattagaaaatattgaaaaaatagctatccctggtccaggctcttgtggcggtatgtatacggctaacactatggcatcagcgattgaagcattaggtatgagcctgccaaattctagtgcgcaagatgctatttcagatgataaaaataacgactgtgttcaagctggacaggccgtccttaatttattaaacaaagacattaaacctcgtgacattatgaccatgaaggcatttgaaaatgctattaccgtaattattgcattgggtggctcaactaatgctgtattgcatttaattgccatggcaagtgctgctgaggttaatcttaaaattgatgactttactcgcattggccaaaaagtacccgttattgctgaccttaaaccatcaggcaaatacatgatgagtgaattggttaaaattggcggtacattgccgctaatgaaaatgttacttgatgcaggattattgcacggagactgcctaacagtaacaggaaaaactctagctgaaaatttagaaaatgttaagccatacgctgattctcaagaaatcattagagcactagacaacccaataaaaaaagattcacaccttagaattttacgtggcaatcttgcaaccgatggtgctgttgcaaaaattactggcaaagaaggtttgagtttcaaaggcaatgcgaaatgtttttctcgtgaagaggatgcgcttgaagccattttaaataatcaaataataacaggtgatgtgattgttattcgctatgaaggccctgtcggaggtcctggtatgcgcgaaatgctcgcccctacttctgcagttatgggcaaaggcttaggtgataaagttgcgttaattaccgatggtcgtttttctggcggtacacatggttttgtagtcggtcacatcacccctgaagcctttgaaggtggtgtactggctgtggttaaagatggagatgaaatcttaattgatgcacaaaacaacgttttagagttattagttgagcaagcaattatcgataaacgtctatataattggacacaacccaaaccaaactacaccaaaggtgtattggctaaatttgcaaagttggctaaatctgcctctgaaggtgcagtgactgattag

SEQ ID NO: 174 - protein, 559 aa, Candidatus Ruthia magnifica
MRRKIMYNPRKYSSQVVDGFERAPSRAMLYPVGFTKEDFNKPQVGIASTWSMVTPCNMHINKLADETLKGVNATGGKAIIFNTITISDGISMGSEGMKYSLVSREVIADSIETVVGCQGFDGVVAIGGCDKNMPGCIIGLVRLNRPSIFVYGGTIQPGKNHTDVVSVFEAVGQFANHTIDAIELENIEKIAIPGPGSCGGMYTANTMASAIEALGMSLPNSSAQDAISDDKNNDCVQAGQAVLNLLNKDIKPRDIMTMKAFENAITVIIALGGSTNAVLHLIAMASAAEVNLKIDDFTRIGQKVPVIADLKPSGKYMMSELVKIGGTLPLMKMLLDAGLLHGDCLTVTGKTLAENLENVKPYADSQEIIRALDNPIKKDSHLRILRGNLATDGAVAKITGKEGLSFKGNAKCFSREEDALEAILNNQIITGDVIVIRYEGPVGGPGMREMLAPTSAVMGKGLGDKVALITDGRFSGGTHGFVVGHITPEAFEGGVLAVVKDGDEILIDAQNNVLELLVEQAIIDKRLYNWTQPKPNYTKGVLAKFAKLAKSASEGAVTD

SEQ ID NO: 175 - DNA, 1689 bp, Methylococcus capsulatus
atgaccgacaagcacccccgtccccattcgtcccaggtcgtcgacggcatggagcgcgccccgagccgcgcgatgctgcacgccgtcggcttcgccgatgccgacttcgccaaaccgcagatcggcatcgcttccacctgggcgatggtgacgccgtgcaacatgcacatcaacaagctcgccgaggacgcagcacgcggcgtcgacggcggcggcggcaaggcagtgatcttcaacaccatcaccatttccgacggcatctcgatgggcaccgaaggaatgaaatactccctcgtgtcgcgggaagtcatcgccgactcgatcgaaaccgtggtggcctgtcagggttatgacggcgtggtcgccatcggcggctgcgacaagaacatgcccggctgcctgatcgccctcgcccgcctcaaccgtccggcggtgttcgtctatggcggcaccatcctgccgggctgccacgacggcaagaagctggacgtggtgtcggtgttcgaagcggtcggcgcccgcgccaaccaccgcatcgacgatgccgaactgcacgccatcgaatccaatgccatccccggtccgggctcctgcggtggcatgtataccgccaacaccatggcctccgccatcgaggcattagggatgagcctgccgggcagttcggcccaggtggccatttcccgcgccaaggaactggattgcgagcgggccggcgcgcaggtcctcaagctcctggacctggggctcaaaccccgcgacatcatgaccaagaaggcgttcgagaacgccatcacggtggtgatcgccctgggcggctccaccaacgccgtgctgcacctcctggccatggccaacgcctgcggcgtcgacctgaagctcgacgatttcacccgcatcgggcgcaaagtgccgatgctggcggatctgaaacccagcggcagatactccatggccgaactggtggaaatcggcggcatccagccgctgatgaagaccttgctggacgcgggactcctgcacggcgactgcatgaccgtaaccggcaagaccctggaagaaaacctggccgacgcgcccgactacccggccggacaagacatgatccggtcgctggacaaccccatcaaaaaggacagccatctggtgatcctcaagggcaacctggcgccggaaggcgcggtcgccaagatcaccggcaaggaaggactgagcttcaccggcaccgcccgcgtattcgactgcgaggaagcggcgctcacggccatcctcgacggcacgatcgtgaaaggcgacgtcatcgtcatccgctatgaaggccccaagggcggccccggcatgcgcgagatgctctcgccgacctcggcggtcatgggcaagggattgggcaaggaggtcgccctcatcaccgacggccgcttttccggcggcacccacggcttcgtggtcggccacatcacgccggaagcctacaccggcggccccctggcgatcgtccgggacggcgataccatcaccatcgacgccgagacccgcgaattgagcctgcacgtcaccgacgatgaaatcggccggcgcctggcgcagtggactcaaccggcgccgcgctacaccaagggcgtgctggccaaatacgccaggttggtgagcccggcctcggaaggcgccgtcaccgacgacggcctctga

SEQ ID NO: 176 - protein, 562 aa, Methylococcus capsulatus
MTDKHPRPHSSQVVDGMERAPSRAMLHAVGFADADFAKPQIGIASTWAMVTPCNMHINKLAEDAARGVDGGGGKAVIFNTITISDGISMGTEGMKYSLVSREVIADSIETVVACQGYDGVVAIGGCDKNMPGCLIALARLNRPAVFVYGGTILPGCHDGKKLDVVSVFEAVGARANHRIDDAELHAIESNAIPGPGSCGGMYTANTMASAIEALGMSLPGSSAQVAISRAKELDCERAGAQVLKLLDLGLKPRDIMTKKAFENAITVVIALGGSTNAVLHLLAMANACGVDLKLDDFTRIGRKVPMLADLKPSGRYSMAELVEIGGIQPLMKTLLDAGLLHGDCMTVTGKTLEENLADAPDYPAGQDMIRSLDNPIKKDSHLVILKGNLAPEGAVAKITGKEGLSFTGTARVFDCEEAALTAILDGTIVKGDVIVIRYEGPKGGPGMREMLSPTSAVMGKGLGKEVALITDGRFSGGTHGFVVGHITPEAYTGGPLAIVRDGDTITIDAETRELSLHVTDDEIGRRLAQWTQPAPRYTKGVLAKYARLVSPASEGAVTDDGL

SEQ ID NO: 177 - DNA, 1662 bp, unknown
  uncultured marine bacterium EB80_02D08
atgacaaatagaaaatattcaaaagaacttttagatggaccaaatcaagcagcatcaagatcaatgcttagaggagtaggatttacatctgatgatttcaagaagccacttgtaggaattgcatcaactggggcaaaagttactccatgcaatatgcatattaatcagctgtcagaaattgttgagcattcagttgataattccggaggtaaaggagtgctattcaatactattacagtttctgatggtatatcaatgggaacacaaggcatgaaatactcactcgtttcaagagaagtcatagcagattctatagaaactgttgtgggctgtcttggttatgatggtgttatagcagttggtggatgtgataaaaatatgcccggatgtattatcggcatggcaaggcttaatagaccttccatatttatatatggtggctcaatcagacccagtgaagaaaataccgattatgtaactgtatgtgaaaagactggtgagttttctaaaggcgatctagacgaatctcaactaattcatgtagaaaaaatatctgtaaagggtcctggatcctgtggaggtatgtatacagccaatactatggcatctgctattgaggcattgggtatgagtcttcctggaagtagcagtcaagatgctgtctcaaatgataaagaagatgattgcataaaagctggtatagcgatcatgggcttattagaaaaagacatcaagccttcagacattatgacaaaaaaagcttttgagaattctataactatggtgattgctttaggcggttccacaaatgcagtacttcatttacttgctatggctgatgcaattggagttgatttaacgcttgatgactttacaagaatcggtaaaaagacgccagtcttagcagatttaaagccttttggctctcattatatgtctgagcttaatgcaaatggagggatacagccgctaatgaaaacccttttagataaaggcttacttcatggtgattgtcttactgttacagggaaaacactctcagaaaatctttctttagttaaaccttatgaattacatcaagatattatcaaggagtttgatagtccaataaaagctaatagtcatctcaggatactatatggaaatttagctgaagaaggagcggttgcaaaaataacaggaaaagagggaacttcttttgaaggtagcgctcgagtttttaattcagaggaagaaggcgttgaggctattttatcaaaatcaattaaacctggcgacgttgtagtaataagatatgagggaccaaaaggtggtcctgggatgagagaaatgttgaagcctacttcggcaatcatgggccaaggcctgggagataaagttgcatttattaccgatggtcgtttttcaggaggtactcatggttttgttgttggacacattacaccagaagcggcagatggtgggctaatagcaattattgaagatggtgattcaatactaattgatgcaaactcggataaactagtactgaatatctctgatgatgagatttcaactagacttagtaaatgggttaaccctaaaacgcctccaagaaaaggtgttctagcaaaatttgcacgaaatgttaaatcagcaagtcttggagcggtgacagattaa

SEQ ID NO: 178 - protein, 553 aa, unknown
  uncultured marine bacterium EB80_02D08
MTNRKYSKELLDGPNQAASRSMLRGVGFTSDDFKKPLVGIASTGAKVTPCNMHINQLSEIVEHSVDNSGGKGVLFNTITVSDGISMGTQGMKYSLVSREVIADSIETVVGCLGYDGVIAVGGCDKNMPGCIIGMARLNRPSIFIYGGSIRPSEENTDYVTVCEKTGEFSKGDLDESQLIHVEKISVKGPGSCGGMYTANTMASAIEALGMSLPGSSSQDAVSNDKEDDCIKAGIAIMGLLEKDIKPSDIMTKKAFENSITMVIALGGSTNAVLHLLAMADAIGVDLTLDDFTRIGKKTPVLADLKPFGSHYMSELNANGGIQPLMKTLLDKGLLHGDCLTVTGKTLSENLSLVKPYELHQDIIKEFDSPIKANSHLRILYGNLAEEGAVAKITGKEGTSFEGSARVFNSEEEGVEAILSKSIKPGDVVVIRYEGPKGGPGMREMLKPTSAIMGQGLGDKVAFITDGRFSGGTHGFVVGHITPEAADGGLIAIIEDGDSILIDANSDKLVLNISDDEISTRLSKWVNPKTPPRKGVLAKFARNVKSASLGAVTD

SEQ ID NO: 179 - DNA, 1599 bp, unknown
  uncultured marine gamma proteobacterium EBAC31A08
atgcttagaggagtaggtttcacatctgaggmtttcacaaaaccatttgttgggattgcttccacaggagcaaaagtaaccccatgcaatatgcacataaatgcactttcagagatcgttgagaaatcagttgatagttcaggaggaaagggtgttctttttaatactattactgtttccgatggaatttctatgggtacacagggtatgaaatattctcttgtttctcgagaggtaattgcagattcaatagaaactgttgtgggatgtcttggttatgatggagttattgctgtcggtggttgtgataaaaatatgcctggatgcattattggaatggcaagattaaatagaccatcaatatttatatatggtggttctatcaaacctagtaaagaaaataccgactatgttactgtttgtgagaaaactggagagtactcaaaaggcgatcttaaagaatctgaattaattcatgtagaaaaaatttccgtaaaagggcctggatcttgtgggggaatgtatacggcaaatactatggcttctgcgattgaagctctaggcatgagtcttcctggaagcagcagtcaagatgcaatttcacacgacaaagaagatgattgttttaaggctggcgaagcgataatgaatttattagaaaaagatattaagccttcagatattatgactaagaatgcttttgagaatgctataacaatggtaattgctctaggaggttcaactaatgcagttctgcatttattggccatggcgcattcaataggggttgatttagagctagatgactttacaagaataggaaaaaaaacacccgttatggcagatcttaagccctttggttctcattatatgtctgaactcaatgctaatggcggtattcagccactaatgaaaactttgcttgagaagggattactacacggcaattgtcttaccgttaccggtcagacgcttgctgaaaatctttctggaataaaaccttacgagcctgatcaagagataattaaatcatttgataatccaattaaatcaaatagccatcttagaattctgtatggcaacttagcgaaagatggtgcagttgcaaaaattacgggtaaagaaggaacttcctttgaaggaagtgctcgtgtatttgattcagaagaagaaggggttaaagcaatcctatctaaatctataaaagctggagatgttgttgtaattagatatgaagggccaaaaggaggtccaggcatgagagaaatgctaaaaccaacatctgccataatgggtcaaggtcttggcgatcaggtagcttttataacagacggtcgtttttcaggaggcactcatggatttgttgttgggcacattactccagaggctgcagatggcggcttaattgcaataattaaagatggcgactctatattaattgatgcagattctgataagttaattcttaatatttctgaggatgaaatttcaaatagactaagtagatgggtaaacccaaaaacgcctcccaaaaaaggagtcttagcaaaatttgcaaaaagtgttaaatcagctagtcttggagcggtaacagattaa

SEQ ID NO: 180 - protein, 532 aa, unknown
  uncultured marine gamma proteobacterium EBAC31A08
  misc_feature (11)..(11): Xaa can be any naturally occurring amino acid
MLRGVGFTSEXFTKPFVGIASTGAKVTPCNMHINALSEIVEKSVDSSGGKGVLFNTITVSDGISMGTQGMKYSLVSREVIADSIETVVGCLGYDGVIAVGGCDKNMPGCIIGMARLNRPSIFIYGGSIKPSKENTDYVTVCEKTGEYSKGDLKESELIHVEKISVKGPGSCGGMYTANTMASAIEALGMSLPGSSSQDAISHDKEDDCFKAGEAIMNLLEKDIKPSDIMTKNAFENAITMVIALGGSTNAVLHLLAMAHSIGVDLELDDFTRIGKKTPVMADLKPFGSHYMSELNANGGIQPLMKTLLEKGLLHGNCLTVTGQTLAENLSGIKPYEPDQEIIKSFDNPIKSNSHLRILYGNLAKDGAVAKITGKEGTSFEGSARVFDSEEEGVKAILSKSIKAGDVVVIRYEGPKGGPGMREMLKPTSAIMGQGLGDQVAFITDGRFSGGTHGFVVGHITPEAADGGLIAIIKDGDSILIDADSDKLILNISEDEISNRLSRWVNPKTPPKKGVLAKFAKSVKSASLGAVTD

SEQ ID NO: 181 - DNA, 1659 bp, unknown
  uncultured marine gamma proteobacterium EBAC20E09
atgagctctagaaaatattcaaaagaccttgttgatggcccaaatcaagctgcatcaagatcaatgctgcgtggggttggatttactactgaagatttttcaaaatcttttgtaggcattgcatcaacaggtgcaaaagttacaccgtgtaatatgcatatcaataaacttgcagaagttgttgagaattcggtgaatgtatctggaggtaaaggagtactttttaatactattactgtatcagacggcatatcaatgggaactcaaggcatgaaatattctcttgtatcaagagaggttatagctgattcaattgaaacagttgttggttgtttaggttatgatggcttaatcacaattggtggctgtgataagaacatgcctggctgtttgataggcatggcaagattgaaccgaccatccattttcatttatggggggtcaattaagccaagtaatgaaaaaaccgactatgtcacagtatcagaaaaggttggtgaattctccaaaggcgacattgatgaaaaagaactcattcattatgaaaaaatttcagtagaaggcccaggatcatgcggtggtatgtataccgcaaatacaatggcttcagctatcgaagctttaggaatgagtttaccaggcagcagcagtcaagatgcagtttcaaaatctaaaaatgaagattgcatttctgcaggaatagccataatgaatttgcttgaaaaagatttaaaaccctctgacattatgacaaaggaggcttttgaaaatgcaattacagttgttattgcattaggtggatcgacaaatgctgttcttcatttattagctatggctcatgccgtaggtgtcgaacttcaattggatgattttacaaaaattggaaaactcactccggtacttgcagacctcaaaccatttggtaatcattttatgtctgagttaaatgcaaacggtggaatacagccactaatgaaaagtttattagataaaggaatgctgcatggaaattgtttgacggttactggtaattcattagaagaaaatttaaaagatatagagccgtataaagatgaaaaaataataaaaagcttagataatccaattaaatctgatagtcatttaagagtgttatatgggaacttagctaaggatggcgctgttgcaaaaattacaggaaaggagggcttttcatttgaaggcaaagccaaagtatttaactcggaagaagatggagttcaggcaatccttgcaaaaaaaattgttccaggtgatgtagttgtaattagatatgagggaccaaaaggtggtccgggcatgagagaaatgttaaagccaacatctgcgatcatggggttaggcttaggagataaagttgcttttataactgacggtagattttctggaggaactcatggatttgttgtgggccatgtatctccagaggcagcagatggaggcctaattgctttaatcaaagatggagacaatatcttgatagatgcagaaaatgatgaattaatactaaaggttgatcaagacgaaattgatttaagaaagaagaactggaaaaatcctactaatcctcctaaaaaaggagttcttgcaaagtatgctgcaagtgtaaaatctgccagcttaggagcaattactgattaa

SEQ ID NO: 182 - protein, 552 aa, unknown
  uncultured marine gamma proteobacterium EBAC20E09
MSSRKYSKDLVDGPNQAASRSMLRGVGFTTEDFSKSFVGIASTGAKVTPCNMHINKLAEVVENSVNVSGGKGVLFNTITVSDGISMGTQGMKYSLVSREVIADSIETVVGCLGYDGLITIGGCDKNMPGCLIGMARLNRPSIFIYGGSIKPSNEKTDYVTVSEKVGEFSKGDIDEKELIHYEKISVEGPGSCGGMYTANTMASAIEALGMSLPGSSSQDAVSKSKNEDCISAGIAIMNLLEKDLKPSDIMTKEAFENAITVVIALGGSTNAVLHLLAMAHAVGVELQLDDFTKIGKLTPVLADLKPFGNHFMSELNANGGIQPLMKSLLDKGMLHGNCLTVTGNSLEENLKDIEPYKDEKIIKSLDNPIKSDSHLRVLYGNLAKDGAVAKITGKEGFSFEGKAKVFNSEEDGVQAILAKKIVPGDVVVIRYEGPKGGPGMREMLKPTSAIMGLGLGDKVAFITDGRFSGGTHGFVVGHVSPEAADGGLIALIKDGDNILIDAENDELILKVDQDEIDLRKKNWKNPTNPPKKGVLAKYAASVKSASLGAITD

SEQ ID NO: 183 - DNA, 1659 bp, unknown
  uncultured gamma proteobacterium eBACHOT4E07
atgagctctagaaaatattcaaaggaattagttgatggtccaaatcaggccgcatctcgttctatgcttcgaggtgtaggatttacatctgaggactttacaaagccatttgttggaattgcatcaactggagccaaagttacaccatgtaatatgcatatcaatcaattatcagaattggtagaagactcaataaatgcatctggtggcaaaggtgttttatttaatacaattactgtttctgatggcatttcaatgggaacgcaaggaatgaaatattctcttgtttcaagagaagttattgctgactcaattgaaactgttgtaggttgccttggatatgatggattaattgcaattggtggatgtgataagaacatgcctggatgtcttattggtatggcaagattaaatagaccgtcaatatttatttatggtggatctataaaaccaagtaatgagaatacggactatgtcactgtctcagaaaaagttggagaattctcaaagggctctataaatgaagatgagctaattcattatgaaaagatatcagttgatggaccaggctcatgtggcggaatgtatacagcaaatacaatggcatctgccatagaggcattaggaatgagtttgccaggtagcagtagccaagatgcaacatctaaatcaaagaacgctgattgtgtgaatgctggatcggcaatcatgaatttactagataaagatattaaaccttctgacattatgacaagagaagcatttgaaaatgctataactgttgtaatagctctaggaggatcaacaaatgccgttcttcatttattggccatggctcattcaattggagttgaactttgcttagatgactttacttcaattggaaagaaaacacctgtattagcggacctaaaaccctttggaaaacactatatgtctgagcttaatgcaaatggaggaattcagcccttaatgaaaactcttttagacaaaggacttcttcatggtcaatgtatgacagttacaggcaataccttagaagaaaatttaaaagacataaaagcatatgagacgagtgaaataattaaagattttaataatccaatcaaaaaagatagtcatcttagaattttatacggcaaccttgctaaagatggcgcggttgcaaaaattacaggtaaagaaggaacatcttttgaaggaaaagcaaaagtatttaattcagaagaagagggcgtaagtgcgattctatcaaatcagattaatgatggtgatgtaatcgtaataaggtatgagggtccaaagggtgggcctggcatgagagaaatgctaaaacctacttctgcaatcatgggattaggactaggagataaaataggatttattacagatggaagattttcaggtggcacccatggttttgtagttggacatgtttctccagaagcagctgagggtggtttaatagcattagttgaagatggagatactatacttattgatgcagaaagtgatcagcttgttctaaaagttgatgatgatgaaattaaaagaagacaatcaatttggaaaaatccaaacagtaaaccaaaaaaaggagtacttgctaagtatgctgagagcgtaaaatctgcaagcctgggagctataactgattaa

SEQ ID NO: 184 - protein, 552 aa, unknown
  uncultured gamma proteobacterium eBACHOT4E07
MSSRKYSKELVDGPNQAASRSMLRGVGFTSEDFTKPFVGIASTGAKVTPCNMHINQLSELVEDSINASGGKGVLFNTITVSDGISMGTQGMKYSLVSREVIADSIETVVGCLGYDGLIAIGGCDKNMPGCLIGMARLNRPSIFIYGGSIKPSNENTDYVTVSEKVGEFSKGSINEDELIHYEKISVDGPGSCGGMYTANTMASAIEALGMSLPGSSSQDATSKSKNADCVNAGSAIMNLLDKDIKPSDIMTREAFENAITVVIALGGSTNAVLHLLAMAHSIGVELCLDDFTSIGKKTPVLADLKPFGKHYMSELNANGGIQPLMKTLLDKGLLHGQCMTVTGNTLEENLKDIKAYETSEIIKDFNNPIKKDSHLRILYGNLAKDGAVAKITGKEGTSFEGKAKVFNSEEEGVSAILSNQINDGDVIVIRYEGPKGGPGMREMLKPTSAIMGLGLGDKIGFITDGRFSGGTHGFVVGHVSPEAAEGGLIALVEDGDTILIDAESDQLVLKVDDDEIKRRQSIWKNPNSKPKKGVLAKYAESVKSASLGAITD

SEQ ID NO: 185 - DNA, 1686 bp, Alcanivorax borkumensis
atgagtgactcaaagggcgatccgcgtcgccgccattcagcaaaggtcgtggacggccccggtaaatccgccagccgggccatgctgcgggcggtggggtttaccgatgaggattttcataaaccccaggtgggcattgcttctacttggagtcaggtgacgccgtgcaatagccatatcggtgagctcgccgaaaaagcctgcgctggagccgatgcggccggcggcaaaggggtaattttcaataccatcaccatctccgatggcatcgccaatggtaccgaagggatgaagtattcgttggtctcccgcgaggtgattgccgattccattgaaaccgtggcggcttgtgaaggctttgacggcctggtagctcttggtggctgcgataagaacatgcccggttgcctaatgggcatggcgcggctgaatcgccccagcgtctttgtctacggcggcaccatcatgcccggcaagggccacacggatattgtttctgtgttcgaagccatgggagcccattcccgcggcgacatggacaaaatcgaactcaagcagatagaagaaactgccattcccgggcccggtgcttgcggcggcatgtacacggccaacactatggcctcggctattgaagcgctgggcatgagcctgccgggcagctccgcacagaatgcggtgtcggaagagaagcgtgatgattgccagcgcgccggcgaagcagtgttggcgctactggaacaggacatcaagccctcggacatcatgacgcgggctgcatttgagaacgccatcactgtggtgatcgccctgggcggttccaccaatgcggtgctgcacctgatcgccatggcgcgcaccgtgggggtgccgctgtcgctggatgactttaccgagatcggcaggcgggtgccggtgctggcggacctgcgccccagtggccattacatgatgagcgagttggtggccatcggcggtattcagccgttgatgaaggtgctgttggaggcgggtttgctgcagggtgattgcctgacggtcaccggccgtaccttggctgagaacctggcggatgtcagtccttatccactggatcagacgatcatcgcgccactgtctgcgccgctgaaagcagaaagtcacctgcgcatcctttatggcaatttggcgccggatggcgcagtggccaagatcaccggcaaggaaggcacccacttttccggcccggcccgggtgttcggttcggaagaagaagcgcagcagcggatcaatgatgggactgtggtgtccggggacgtggtggtgatccgctatgaaggcccccgcggcggcccaggcatgcgtgaaatgctcacccccacctctgccatcatggggcgcggcctgggtgacgaggtggcgctgattaccgatggtcgcttttccggcggcagccatggtttcgtggtaggccacgtgaccccagaagctttcgatggtggtccgctggcattattggaaaacggtgaccaaattaccattgatgccgaagccaacaccctggtcgtggcgctgtctgatgcggagttggcgcgccgccgtgctaactggcaacagccagcaccacgctatacccgtggtgtgctggccaaatacgcacggctggtgggttcggccagcgaaggcgcgctgacggacttaggttaa

SEQ ID NO: 186 - protein, 561 aa, Alcanivorax borkumensis
MSDSKGDPRRRHSAKVVDGPGKSASRAMLRAVGFTDEDFHKPQVGIASTWSQVTPCNSHIGELAEKACAGADAAGGKGVIFNTITISDGIANGTEGMKYSLVSREVIADSIETVAACEGFDGLVALGGCDKNMPGCLMGMARLNRPSVFVYGGTIMPGKGHTDIVSVFEAMGAHSRGDMDKIELKQIEETAIPGPGACGGMYTANTMASAIEALGMSLPGSSAQNAVSEEKRDDCQRAGEAVLALLEQDIKPSDIMTRAAFENAITVVIALGGSTNAVLHLIAMARTVGVPLSLDDFTEIGRRVPVLADLRPSGHYMMSELVAIGGIQPLMKVLLEAGLLQGDCLTVTGRTLAENLADVSPYPLDQTIIAPLSAPLKAESHLRILYGNLAPDGAVAKITGKEGTHFSGPARVFGSEEEAQQRINDGTVVSGDVVVIRYEGPRGGPGMREMLTPTSAIMGRGLGDEVALITDGRFSGGSHGFVVGHVTPEAFDGGPLALLENGDQITIDAEANTLVVALSDAELARRRANWQQPAPRYTRGVLAKYARLVGSASEGALTDLG

SEQ ID NO: 187 - DNA, 1713 bp, Chromohalobacter salexigens
atgagccagcaggactcccccgccaacgccgatcaccgtcgccgccattcctccatcgtggtcgacggccccggcaaggccgccagtcgcgccatgctgcgtgccgtcggtttcaccgacgaggatttcaagaagccgcaggtggggatcgcctcgacctggagtcgcgtcacgccgtgcaacagccacatcaacgtgttggccgatgccgccagtgacggcgccgacgccgccggtggcaagggcgtggtcttcaataccatcaccatcagcgacggcatcgccaacggcaccgaaggcatgaagtattcgatggcctcgcgcgagatcatcgccgattccatcgaggcggtctccggctgcgaggggttcgacggggtggtggccatcggtggctgcgacaagaacatgcccggctgcatgatcggcctggcacgtctcaaccggcccagcatcttcgtctacggcggtaccatccagcccggtgccgggcacaccgacctggtctcggtattcgaggcgatgggcgcctactcccagggcaacaagtcgctgatcgaggtcaagcagatcgaggaagtcgcgattcccgggccgggctcctgtggcggcatgtacaccgccaacaccatggcctcggcgatcgaggccatgggcatgagcctgcccaattcgtcggctcaggacgcggtatcccagagcaagaaggacgatagtcgcgccgccggcgaggccgtgctcaagctgctcgaactggacatcaagccctcggacatcatgacccgcaaggcgttcgagaacgccatcaccgtggtcatcgccctcggcggttccaccaatgccgtgctgcacctgattgccatggccaacaccatcggggtcgagctctcgctcgacgactttaccgagatcggcaagcgcgtcccggtgctcgccgacctgcgccccagcggtcattatctgatgagcgagctggtggcgatcggcggcattcagccgatgatgaagattctgctcgatgcggggctgctccacggcgattgcctgaccgtgaccggcaagacgctggccgagaacctggccgacgtgacgccttatccgacggggcaggaaatcatcaagccgctggaggcaccgatcaaatcgagcagccacctgcgcattctctacggcaacctggcgccagagggagcggtggccaagatcaccggcaaggaaggtacccgcttcaccgggcgtgctcgcgtgttcaactccgaggaggaggcccaggcgcgcatcaacgacctgaccgtggccgccggtgacgtcgtcgtgattcgctacgaggggccgaagggcggtcccggcatgcgcgaaatgctgacgccgacctcggcgatcatgggccgtggcctgggcgacaaggtggccttgatcaccgatggacgcttctccggcggcagccatggcttcgtggtcggtcacatcacgccggaagccttcgtcggcggccccatcggcctggtcgaggacggtgacgagatcaccatcgacgccgagaacgacatcatgacgctgcatatcgacgacgccgagatggcgcgccgccgtgcggcctggaagcgcccggcaccgcgttatacgcgcggcacgctggccaagtacgccaagacggtcagctcggcatcgaaaggggcggtcaccgatctgcccgaagcgctggacgattga

SEQ ID NO: 188 - protein, 570 aa, Chromohalobacter salexigens
MSQQDSPANADHRRRHSSIVVDGPGKAASRAMLRAVGFTDEDFKKPQVGIASTWSRVTPCNSHINVLADAASDGADAAGGKGVVFNTITISDGIANGTEGMKYSMASREIIADSIEAVSGCEGFDGVVAIGGCDKNMPGCMIGLARLNRPSIFVYGGTIQPGAGHTDLVSVFEAMGAYSQGNKSLIEVKQIEEVAIPGPGSCGGMYTANTMASAIEAMGMSLPNSSAQDAVSQSKKDDSRAAGEAVLKLLELDIKPSDIMTRKAFENAITVVIALGGSTNAVLHLIAMANTIGVELSLDDFTEIGKRVPVLADLRPSGHYLMSELVAIGGIQPMMKILLDAGLLHGDCLTVTGKTLAENLADVTPYPTGQEIIKPLEAPIKSSSHLRILYGNLAPEGAVAKITGKEGTRFTGRARVFNSEEEAQARINDLTVAAGDVVVIRYEGPKGGPGMREMLTPTSAIMGRGLGDKVALITDGRFSGGSHGFVVGHITPEAFVGGPIGLVEDGDEITIDAENDIMTLHIDDAEMARRRAAWKRPAPRYTRGTLAKYAKTVSSASKGAVTDLPEALDD

SEQ ID NO: 189 - DNA, 1677 bp, Marinobacter algicola
atgacagaagacaaacgccgccgttattccgcgcccgtggtcgatggcctgggcaagtcggcaagccgcgccatgttgcgggccgtggggtttaccgatgaagatttccgcaaaccccagatcggtattgcctcgacctggagcaacctgacgccctgcaatatgcacatcaaccaactggcggaggaatcggccgcgggtgccgacgaggccgggggcaagagcctgacgttcaataccatcaccgtttccgacggcatcgccaacggcacggagggtatgaagtactccctggtgtcgcgggaagtcattgccgactccattgaaaccgtggctggttgtgaaggttttgatggcctggttgccattggcggctgcgacaagaacatgcccggctgcatgatgggcctggcgcgcctgaaccggccgtcggtatttgtctatggcggcaccatcatgcccggcgagaatcacaccgacatcatctcagtatttgaggcggtgggtgcccatgcccggggtgacctggacctgattgaggtcaaacagatcgaggaaaccgcgattccggggccaggctcctgcggcggcatgtacaccgccaacactatggcctcggcgattgaagccatgggcatgagcctgccgggcagttccgcccagaacgctgtttccgagaccaaggcggccgactgcagggcggcgggcgcggccgtcctcaacctgctggagaaagatctcaagccatcggacatcatgacccgggaggcgttcgagaatgctatcaccgtggtaattgccctgggtggctccaccaacgcggtgctgcacctgattgccatggccagcaccgttggcgttgacttgacgctggacgacttcgtggaaatcggcaaacgggttcccgtattggcagatctgcgccccagcggtcactacatgatgtcggaactggtggcgatcggcggcattcagccgttgatgaagatgctgctcgaccgtggcatgctccatggcaactgcatgaccgtcaccgggcagacactggcggacaacctgaaagacgtggctccgtacccggcaagccaggacatcattcatgcctttgatgaccccatcaaggcggatagccatctgcgtatcctttacggcaacctggcgcctactggtgcggtggccaagatcactggtaaggagggtacccatttcaccggccgtgcacgggtgttccagtccgaggaagaggcccaggagcggatcatggacggcaccgttgtggccggagacgtgttggtgatccggtttgaaggccccaaaggtgggccgggcatgcgggagatgctaacgccgacttctgccatcatgggtaaagggctgggcagcgatgtggcgctgattaccgacgggcgtttttccggtggcagccacggtttcgtggttggtcatattacgccggaggccgcagaaggtgggccgattgcgctggtggaaactggcgacaccatcaccattgatgcagtggccaatcgcattgagctggatgtttcggagcaggaaatggagcgccgccgacaggcatggaccgcaccggctccccgatttacccgcggggtgctggccaaatacgcgcgcaccgtgagttccgcttcggaaggcgcagtgacagacaagccgtga

SEQ ID NO: 190 - protein, 558 aa, Marinobacter algicola
MTEDKRRRYSAPVVDGLGKSASRAMLRAVGFTDEDFRKPQIGIASTWSNLTPCNMHINQLAEESAAGADEAGGKSLTFNTITVSDGIANGTEGMKYSLVSREVIADSIETVAGCEGFDGLVAIGGCDKNMPGCMMGLARLNRPSVFVYGGTIMPGENHTDIISVFEAVGAHARGDLDLIEVKQIEETAIPGPGSCGGMYTANTMASAIEAMGMSLPGSSAQNAVSETKAADCRAAGAAVLNLLEKDLKPSDIMTREAFENAITVVIALGGSTNAVLHLIAMASTVGVDLTLDDFVEIGKRVPVLADLRPSGHYMMSELVAIGGIQPLMKMLLDRGMLHGNCMTVTGQTLADNLKDVAPYPASQDIIHAFDDPIKADSHLRILYGNLAPTGAVAKITGKEGTHFTGRARVFQSEEEAQERIMDGTVVAGDVLVIRFEGPKGGPGMREMLTPTSAIMGKGLGSDVALITDGRFSGGSHGFVVGHITPEAAEGGPIALVETGDTITIDAVANRIELDVSEQEMERRRQAWTAPAPRFTRGVLAKYARTVSSASEGAVTDKP

SEQ ID NO: 191 - DNA, 1677 bp, Marinobacter aquaeolei
atgacaaccgataaacgacgccgacactcggcaccggtggtagacggtatcaataaatccgccagccgggccatgctccgggcggtaggttttaccgacgaggatttccgcaaaccccagattggcattgcctccacctggagcaaccttacgccctgcaacatgcacattgacggcctggcccgggaggccgccaagggtgccgacggagccgggggcaagagcctgatcttcaacaccatcactatctctgatggcatcgccaacggcaccgagggcatgaaatattccctggtgtcgcgcgaggtgattgccgattccattgagaccgtggccggttgtgagggcttcgacggactggtcgccatcggtggctgcgacaagaacatgcccggctgcatgatgggcctggcccggctgaaccggccctcggtcttcgtttacggcggcaccatcatgcccggcgagaaccataccgacatcatctccgtgtttgaggcggtgggcgcccatgcccgcggtaacatggagctgatcgaagtcaaacagatcgaggaaaccgcgattcccgggccaggctcctgtggcggcatgtacaccgccaacaccatggcctccgccattgaggccatgggtatgagcctgccaggcagctcggcccagaacgccatctccgacagcaaactggcggattgcgaagccgcaggcgccgcggtgctgaaactgctcgaagccgatatcaagccctccgacatcatgacccgggaagcgttcgagaacgccatcaccgtggtggtcgcgctgggcggttccaccaacgccgtgctgcaccttctgggtatggccagtaccgtgggagtggagctgtcactggacgatttcgtacgcatcggcaaacaggtaccagtcctggcggaccttcgcccctccggccactacatgatgtccgagctggtggccattggtggcattcaaccgctaatgaagatgctgctcgaccgggggctgctgcatggagactgcctcacggtaaccggcaaaaccctggcagagaatctcgagaccgtggtgccctaccccgaagaccagcagatcatccacgccttcgacaacccgatcaaagccgacagtcatctgcgtattctctatggcaacctggctccggaaggctcggtggcgaaaatcaccggtaaggaaggcacgcatttttccggtcgagcccgagtgtttcactctgaagaggaagcccaggagcgaatcctggatggcaccgtggtcgctggcgacgtgctggtgatccgatacgaaggcccgaagggcgggcctggcatgcgggaaatgctcagccccacctcggcgattatgggcaaaggtcttggcagtgatgtggctctgattacagacggccgcttctccggtggcagtcatggttttgtggttggccatatcacaccagaggccgccgtgggcgggccgattgcgctggtagaagacggcgacaccattaccattgatgccgtgagcaactcgattgtgctggaaatctctgacgaggaaatggaaaaacggcgcaaagcctggacgccgccggaacccagatttacccggggcgtgctggccaaatatgcccgtgtggtgagctctgcatctacgggggccgttaccgacctgccctag

SEQ ID NO: 192 - protein, 558 aa, Marinobacter aquaeolei
MTTDKRRRHSAPVVDGINKSASRAMLRAVGFTDEDFRKPQIGIASTWSNLTPCNMHIDGLAREAAKGADGAGGKSLIFNTITISDGIANGTEGMKYSLVSREVIADSIETVAGCEGFDGLVAIGGCDKNMPGCMMGLARLNRPSVFVYGGTIMPGENHTDIISVFEAVGAHARGNMELIEVKQIEETAIPGPGSCGGMYTANTMASAIEAMGMSLPGSSAQNAISDSKLADCEAAGAAVLKLLEADIKPSDIMTREAFENAITVVVALGGSTNAVLHLLGMASTVGVELSLDDFVRIGKQVPVLADLRPSGHYMMSELVAIGGIQPLMKMLLDRGLLHGDCLTVTGKTLAENLETVVPYPEDQQIIHAFDNPIKADSHLRILYGNLAPEGSVAKITGKEGTHFSGRARVFHSEEEAQERILDGTVVAGDVLVIRYEGPKGGPGMREMLSPTSAIMGKGLGSDVALITDGRFSGGSHGFVVGHITPEAAVGGPIALVEDGDTITIDAVSNSIVLEISDEEMEKRRKAWTPPEPRFTRGVLAKYARVVSSASTGAVTDLP

SEQ ID NO: 193 - DNA, 1692 bp, Marinobacter sp.
atgagtgataccccccaagaccctcgccgccgttattccgctccggttgtggacggtgtggctaaatccgccagtcgttccatgctgagggccgtcggttttaacgacgaagatttcagcaaaccgcagatcggcattgcttccacctggagtatggttaccccctgtaatagccacattaacgagctggccgacattgcttgtaagggtgcggaccaggccggtggtaaaggcgttatttttaacaccattacgatttctgacggcattgccaacggcaccgaaggaatgaagtattccctggtgtcgcgggaagtcatcgcagattccattgaaaccgtggccggttgcgagggttttgacggcctggttgccattggcggctgtgacaaaaacatgcccggctgcatcatgggcctggcgcggcttaaccggcccagcgtgtttgtttatggcggtactattttgcctggtgaaggtcacaccgacattatttcagtgtttgaagcggtgggcgcccatgccaaaggcgaactgtcgttgattgaagtgaagcatattgaagaaaccgccattcccggccccggttcctgtggcggcatgtacaccgccaataccatggcctcggccatagaagcactgggtatgagcctgcccggcagctcggcgcagaatgcggtgtcgaatgacaaaaaagccgattgcgaagccgccggtgccgcggtcatgaatctgttggatcgagatatcaaaccttccgacattatgactcagcacgcctttgagaacgccatcactgtgatcatcaccttgggtggttccaccaacgccgtactgcacctgattggtatggccaacacggcgggtgtagagctaaccctggatgacttcactcgcattggtaaaaaggttccattgttggcggatctgcgccctagcggccattacatgatgagcgaattggtggccattggcggcatccagccactcatgaaaatgctgctagacgccggcatgctccacggcgattgcctgacagtaaccggcaaaactctggccgaaaacctggccacggtagaaccttatgccgatggccagaaaatcattatgcctctggaccagcccattaaagcggaaagccacctgcgcattctgtttggtaatctggcgccggaaggctccgtggcaaaaattaccggtaaggaaggcacccactttaaaggtcgggcgcgggtgtttggttcggaagaagaagcccaagcacgaattctggacggcactgtggtggctggcgatgtgctggttatccgctatgaaggcccacgcggcggccccggcatgcgcgaaatgctgtcacccacctcggcgattatgggccgtgggctgggcagcgatgtggctttgataactgacggtcgtttctccggtggtagccacggcttcgtcgtaggccacattacgccggaagcgtttgatggcggccctattgccttggtgcaagacggcgacgaaatcgtgattgatgccgtggccgacactattgagctaaatgtcagtgacgacgaactgcagagccgtcgcgacgcctggcagcaaccgcaaccgcgttacacccgcggtgtgttagccaagtatgcgcgcaccgtgagttcggcgtcgaccggtgcagtgaccgacctgcccgagccttga

SEQ ID NO: 194 - protein, 563 aa, Marinobacter sp.
MSDTPQDPRRRYSAPVVDGVAKSASRSMLRAVGFNDEDFSKPQIGIASTWSMVTPCNSHINELADIACKGADQAGGKGVIFNTITISDGIANGTEGMKYSLVSREVIADSIETVAGCEGFDGLVAIGGCDKNMPGCIMGLARLNRPSVFVYGGTILPGEGHTDIISVFEAVGAHAKGELSLIEVKHIEETAIPGPGSCGGMYTANTMASAIEALGMSLPGSSAQNAVSNDKKADCEAAGAAVMNLLDRDIKPSDIMTQHAFENAITVIITLGGSTNAVLHLIGMANTAGVELTLDDFTRIGKKVPLLADLRPSGHYMMSELVAIGGIQPLMKMLLDAGMLHGDCLTVTGKTLAENLATVEPYADGQKIIMPLDQPIKAESHLRILFGNLAPEGSVAKITGKEGTHFKGRARVFGSEEEAQARILDGTVVAGDVLVIRYEGPRGGPGMREMLSPTSAIMGRGLGSDVALITDGRFSGGSHGFVVGHITPEAFDGGPIALVQDGDEIVIDAVADTIELNVSDDELQSRRDAWQQPQPRYTRGVLAKYARTVSSASTGAVTDLPEP

SEQ ID NO: 195 - DNA, 1680 bp, Pseudoalteromonas haloplanktis
atgacttctgaaaaaccacgtaaatattcacaaaaaattgtagatggtagcgctcaggctcctagtcgttctatgttacgagcggtaggttttaatgatgacgattttaaaaagtctcaagttggtattgcctctacatggtctatggtaacgccgtgcaatatgcacattaatacacttgccgaagaagtaggtaaaggcgtagatagcgccggtgcgaaaagcgttatatataataccattaccgtatccgatggtatttctatgggcaccgaagggatgaaatattctttagtatcacgcgaagtaatttgcgactcaatagaagcggtatcggcgggtatgggccacgacggtattattgctattggcggttgtgataaaaatatgccgggttgtttaatgggtttagcacgtttaaaccgcccctctatatttgtgtacggcggtacaattttacccggtgaaaatcataccgatatagtctcggtatttgaagcggtgggcagctacgcggcaggcgatattccaattacgcaattagaacatattgaaaaaacagccataccaggggctggttcgtgtggtggtatgtacacggcaaatacgttagcctcagcaattgaagctttaggcatgagtatgccaaatagttctgcgcaaaatgctatttcacaaaacaaaaaacaagactgtattgatgcgggtaaagcgattgtttatttgctagagcatgacattaaaccttccgatattatgaccaaaaaagcgtttgaaaatgcaattacgctgatcattaccttaggcggctcaaccaatgcggtgctgcatttaatcgctatggctgatgcggtaggcgttgaagtaacattggatgactttgtgcgtattggcgataaaacaccagtaattgccgacttgcgtcccagcggtcaatatttaatgtcggagttgattgaaattggtggcattcaaccactgatgaagcgtttattagatgccggtatgctgcacggtgactgtatgacagtgacaggcaaaaccatggccgaaaatttagccgatgtagcagattacccagcagggcaaaatattattttaccttttgataagccgattaaaaaagacagccatttagttatattagctggtaatttagcgccagaaggggcagtgtcaaaaattacgggtaaagagggtttacgctttaccggcaacgcaaaagtatatgactcagaagagcaaggttttgccgctattatagatgggcaagtagtagccggagacgttgtagtaattcgctatgaaggccctaaaggtggcccaggtatgcgtgaaatgctaagccccacttcagctattatgggtaaaggtttaggtaacgatgtggcgcttattaccgatggtcgtttttcaggtggtagtaggggttttgttgtggggcacgttacaccagaagcttacgaaggcggcgccattgcactagtagaaaatggtgacagcattactattgacgcgcaaagccgtgaaatgactcttaatattactgatgaagaaatggccagtaggaaacaacgttggcaacaacctgcgccaaaatacacccgcggattactagcaaaatatgccagaacagtaagttcagcttctaccggagccgtgaccgataagccaagttaa

SEQ ID NO: 196 - protein, 559 aa, Pseudoalteromonas haloplanktis
MTSEKPRKYSQKIVDGSAQAPSRSMLRAVGFNDDDFKKSQVGIASTWSMVTPCNMHINTLAEEVGKGVDSAGAKSVIYNTITVSDGISMGTEGMKYSLVSREVICDSIEAVSAGMGHDGIIAIGGCDKNMPGCLMGLARLNRPSIFVYGGTILPGENHTDIVSVFEAVGSYAAGDIPITQLEHIEKTAIPGAGSCGGMYTANTLASAIEALGMSMPNSSAQNAISQNKKQDCIDAGKAIVYLLEHDIKPSDIMTKKAFENAITLIITLGGSTNAVLHLIAMADAVGVEVTLDDFVRIGDKTPVIADLRPSGQYLMSELIEIGGIQPLMKRLLDAGMLHGDCMTVTGKTMAENLADVADYPAGQNIILPFDKPIKKDSHLVILAGNLAPEGAVSKITGKEGLRFTGNAKVYDSEEQGFAAIIDGQVVAGDVVVIRYEGPKGGPGMREMLSPTSAIMGKGLGNDVALITDGRFSGGSRGFVVGHVTPEAYEGGAIALVENGDSITIDAQSREMTLNITDEEMASRKQRWQQPAPKYTRGLLAKYARTVSSASTGAVTDKPS

SEQ ID NO: 197 - DNA, 1686 bp, Acinetobacter sp.
atgagtaaagacaatatacgccagtattcggcaccagtttatgacggtattgaaaatgcccctgcacgttcgatgatgcgtgctgtgggctttcaagataaagattttaatcgtccatttattggcattgcttcaacatgggccaatgtcacgccgtgcaacatgcacattgatggactggcacgagaagctgaacatggggtgaatcaggccagcggtaagggaattatttttaacactattaccatttctgacggtatttcaaacggtaccgaaggcatgaagtattctttggtttctcgtgaaattattgcagactctattgaggcggtcattggttgtcagggttacgatggtgtaattgccattggtggctgcgacaaaaacatgcctggctgtattatggggctggcacgtttgaaccgtccaggcttgtttatttatggcggcaccattcaaccaggtgaaggacataccgacatgatttcggtgtttgaagcggtgggacagtacgccaaaggagaaatcaatgccattcaggtcaagcagattgaagaagtcgctttaccaggaccaggttcttgcgggggaatgtataccgccaataccatggcttctgctattgaagcactgggaatgagtttaccaggttcttctgcacaggatgccatttctgaagaaaagcgtcaggactgtcatcgtgcgggcgaggcggtgatgaacctgcttcggctggatattcgtccacgcgatattatgaccaaagcggcatttgagaatgccattaaggtcgtcattgctttgggcggttcaaccaatgccgtattgcatttgattgcaatggcacatacggctgaggtaaagcttgatctggatgattttgtacgaattggtcaggaaacacctgtggtggcagatttacgaccatcgggtaagtatctcatgtccgaactgatcaagattggtgggattcagccgttgatgaagcgaatgctggaacgcggcatgctggatggtagttgtctgactgtaactggtaagacccttgcagagaatttggccgaggttgaggattatcctgccgatcaacaaattatcttgccatttgagcaacctgttaagaaagactcccatctagtgattcttaagggtaatttgtccccgacaggtgccgttgccaaaattacgggcaaagaaggtttatattttgaagggccagcccgcgtttttgaaggcgaagaaggcgccatgcgtggcattctagacggagaagtacaagagggcgaagttgtcgtcattcgtggtgaaggacccaaaggtggaccaggcatgcgcgaaatgctgaaaccaacgtctgcaattattggtaaaggactgggacaatcggtggcgctgattaccgatgggcggttttcgggcggcagtcatggctttgtcattggccatgtgaccccagaagcttacgaaggtgggcctattggtttggttgaaaatggtgataaaatttcaatcaatgctgaaacgcgtgaaatcaccttacatatttctaacgaagaaatgagcttacgtcgtgcaaaatggcagaaaccagaaccaaaatataaatctggtgctttggcaaaatttgcaaaacttgcagcaggtgcggacaaaggcgcagttactgatttaaatcttgatgtgtaa

SEQ ID NO: 198 - protein, 561 aa, Acinetobacter sp.
MSKDNIRQYSAPVYDGIENAPARSMMRAVGFQDKDFNRPFIGIASTWANVTPCNMHIDGLAREAEHGVNQASGKGIIFNTITISDGISNGTEGMKYSLVSREIIADSIEAVIGCQGYDGVIAIGGCDKNMPGCIMGLARLNRPGLFIYGGTIQPGEGHTDMISVFEAVGQYAKGEINAIQVKQIEEVALPGPGSCGGMYTANTMASAIEALGMSLPGSSAQDAISEEKRQDCHRAGEAVMNLLRLDIRPRDIMTKAAFENAIKVVIALGGSTNAVLHLIAMAHTAEVKLDLDDFVRIGQETPVVADLRPSGKYLMSELIKIGGIQPLMKRMLERGMLDGSCLTVTGKTLAENLAEVEDYPADQQIILPFEQPVKKDSHLVILKGNLSPTGAVAKITGKEGLYFEGPARVFEGEEGAMRGILDGEVQEGEVVVIRGEGPKGGPGMREMLKPTSAIIGKGLGQSVALITDGRFSGGSHGFVIGHVTPEAYEGGPIGLVENGDKISINAETREITLHISNEEMSLRRAKWQKPEPKYKSGALAKFAKLAAGADKGAVTDLNLDV

SEQ ID NO: 199 - DNA, 1737 bp, Opitutaceae bacterium
atgaagccgacgaccgccaagaccaagcctgccacagccgccaagaccgccaacgccacgcgccagttctcctccatcgtgcacgacggagccgaccgcgcccccaatcgctccatgctccgcgccgtcggattcggcgatgcggatttcaagaaaaccgtcgtcggcgtcgcctccacctggtcgatgctcaccccgtgcaacatgcacatcaacaagctcgccgaatacgccgagcagggcgccaacgaagccggcggcaagggcatcatcttcggcaccatcaccatcgccgacggcatcagcatgggaacgcccggcatgcgctactcgctcgtgtcccgcgaagtcattgccgactccatcgaaaccgtggttggcggcgaaggttttgacggccttgtcgccatcggcggctgcgacaaaaacatgcccggctgcgttatggccatggcccgtctcaaccgccccagcgttttcgtttacggcggcaccattcttcccggcatccacccggaaaccaaaaaggacctcgacatcgtttccgtcttcgaagccgtcggccagcacgccgcgggcaagatcaacgacgctgcgctcaaggttgttgaggaatgctccatccccggtcccggttcctgcggcggtatgtataccgccaatacaatggccaacgccatcgaagccctcggcctctcgctgcccaattcctccgcgcaaatcgccatctccaaggaaaaacaagaagactgtcgccgcgccggagccgctgtcgttgaactcgcaaaaaaggggattcgtccgcgtgacattttaaccaaaaaagcctttgaaaacgccatcactgtagtgatcgccctcggtggctcaaccaatgccgtcctgcacctcctcgccatcgcgcacactgccggcgtgaagctcaccatcgacgacttcacccgcatcggcaaacgcgtgcccgtgctcgccgatctcaaaccttcgggcaaatacggcatggtgcatctctctcgcatcggcggcgtgcctccgctcatgaagaccttgctcgaccgcggtctcatccacggcgactgcctcaccgtcaccggcaagaccgtggcggaaaacctcaaggacgtgcagccgtatccagaaaatcaggacgtgatccgtccctttgaccaaccgatcaagcccgacagccacctgcgcattctctacggcaacctcgccgccgagggttccgtggccaagatctccggcaaggaaggcttaaagttttccggcaaagccatcgtgttcgagggagaggaggccgcgttgtctgccatcctcgacggacgcgtgaagtccggccacgtcgtcgtgatccgcaatgagggtcccgtgggcggccccggcatgagggagatgctcgcccccaccagcgccatcatgggcaagggactcggcaaggaagtcgcgctcatcaccgacggacgtttttcgggcggttcgcacggatttgtggtcggccacatcacacccgaggcggcgattggcggcaccatcggcgtcgtgaaaaacggcgacccgatcaccatcgacgccgtaaaaaaccagatcacgctcgacattcccgcgaaggaaatcgccgcgcgcaaaaagacctggaagccacgcaagccctacaccaatcgcggtgtgttggcgaagtatgccaaactcgtcagcaccgccagcgaaggcgcggtgacggacaagtatttgtaa

SEQ ID NO: 200 - protein, 578 aa, Opitutaceae bacterium
MKPTTAKTKPATAAKTANATRQFSSIVHDGADRAPNRSMLRAVGFGDADFKKTVVGVASTWSMLTPCNMHINKLAEYAEQGANEAGGKGIIFGTITIADGISMGTPGMRYSLVSREVIADSIETVVGGEGFDGLVAIGGCDKNMPGCVMAMARLNRPSVFVYGGTILPGIHPETKKDLDIVSVFEAVGQHAAGKINDAALKVVEECSIPGPGSCGGMYTANTMANAIEALGLSLPNSSAQIAISKEKQEDCRRAGAAVVELAKKGIRPRDILTKKAFENAITVVIALGGSTNAVLHLLAIAHTAGVKLTIDDFTRIGKRVPVLADLKPSGKYGMVHLSRIGGVPPLMKTLLDRGLIHGDCLTVTGKTVAENLKDVQPYPENQDVIRPFDQPIKPDSHLRILYGNLAAEGSVAKISGKEGLKFSGKAIVFEGEEAALSAILDGRVKSGHVVVIRNEGPVGGPGMREMLAPTSAIMGKGLGKEVALITDGRFSGGSHGFVVGHITPEAAIGGTIGVVKNGDPITIDAVKNQITLDIPAKEIAARKKTWKPRKPYTNRGVLAKYAKLVSTASEGAVTDKYL

SEQ ID NO: 201 - DNA, 1683 bp, Flavobacterium sp.
atggaattaaataaatacagtaaaactgtaactcaagacccaacattgcctgcggctcaagcaatgctgcacgcaataggtttaaccgatgaagatctcaagaaaccattaattggtatcgcaagtactggttatgaggggaatccttgtaatatgcaccttaatgatttggcaacctacgtcaagaaaggtgcgtctaatgcagatttagtcggacttattttcaatacgatcggtgtaagtgatggtatttctaacggaactccgggaatgcgtttctcgctgccgtcacgtgatatcatcgctgattctatggaaaccgtggttcaagcaatgagttatgacggtctggttacagttgtgggctgtgataaaaatatgccgggggcattaattgcgcaattgcgattaaatcgcccgtcaattttagtttatggaggaacgatcgcttccggatgccataacggaaaaaaactagatatcatttctgcttttgaggcttatggtcaaaaagttgcaggaactattgatgataatgagtttaaagaagtagtacacaaagcgtgtccgggtgccggtgcttgtggtggtatgtatactgcaaatactatggcttctgctattgaagctttaggaatgtcattgccttttaactcatcgaaccctgcagttactgatgctaatattaaagagcaggaatgtattaaagcaggtgaggctttaaaatatttattagagcaggatattaaaccttcagatattgtaacaaaagagtcgctcgagaatgcgattcgcttggtgactgttttgggaggttctaccaacgcagtattgcactttttagcaatagctaaagcagctcaggtagattttacgctagaagattttcagcgcctgagtgataatacaccgttgttagcagatcttaaaccttcaggtaaatattctatggaagatttacacggtgttggcggaattccgggagtattaaaatatatgcttgataacggtatgcttcacggggattgtttaaccgttaccggaaaaactttagctgaaaacctaaaagatgttcccaatcttatagatggtcaggatattattagaccgttgaataagccaattaaagatagtggccatatccgtatactattcgggaacttggctactgaaggagctgtagcaaagattaccggtaaggaagggctttcgtttacaggaactgccaatgtattcaacagcgaattagaggtaaacgaaggaattaaatcaggaaaagttaaaaaaggtgacgtagtgatcattcgctatgaaggacctaaaggtggtcccggaatgccagaaatgcttaagcctacctcttcaattatgggagccggtttaggtaaagacgttgctttgattactgacggaagattctctggtggatcgcacggatttgtggtggggcacgtttctcccgaagcacaagtgggtggaaatatcgcacttgtagaaaatggagatgtcatttctattgatgccgtaaagaataccatcaacatcgatattaccgatgaagaattggcaaaacgaagagaaaaatggacagctccggaacttagattccaacgcggagcgttatataaatatgcgaaaacagtctcgtcagcttctaaaggttgtgtgacagacgaaatgtag

SEQ ID NO: 202 - protein, 560 aa, Flavobacterium sp.
MELNKYSKTVTQDPTLPAAQAMLHAIGLTDEDLKKPLIGIASTGYEGNPCNMHLNDLATYVKKGASNADLVGLIFNTIGVSDGISNGTPGMRFSLPSRDIIADSMETVVQAMSYDGLVTVVGCDKNMPGALIAQLRLNRPSILVYGGTIASGCHNGKKLDIISAFEAYGQKVAGTIDDNEFKEVVHKACPGAGACGGMYTANTMASAIEALGMSLPFNSSNPAVTDANIKEQECIKAGEALKYLLEQDIKPSDIVTKESLENAIRLVTVLGGSTNAVLHFLAIAKAAQVDFTLEDFQRLSDNTPLLADLKPSGKYSMEDLHGVGGIPGVLKYMLDNGMLHGDCLTVTGKTLAENLKDVPNLIDGQDIIRPLNKPIKDSGHIRILFGNLATEGAVAKITGKEGLSFTGTANVFNSELEVNEGIKSGKVKKGDVVIIRYEGPKGGPGMPEMLKPTSSIMGAGLGKDVALITDGRFSGGSHGFVVGHVSPEAQVGGNIALVENGDVISIDAVKNTINIDITDEELAKRREKWTAPELRFQRGALYKYAKTVSSASKGCVTDEM

SEQ ID NO: 203 - DNA, 1680 bp, Cellulophaga sp.
ttgaaagaacttaataaatatagtaaagcggtaactcaagatcctacgcagccagctgctcaggcaatgttgcacgctataggacttacagatgaagattttaaaaagccacttgtaggtattgcaagtacaggttatgagggtaatccttgtaatatgcacttaaataaccttgcactagatattaaaaaaggagtacaaacttctgatctggtaggtcttatttataataccataggtgtaagtgacggtatctcaatgggtactcctggtatgcggtactcactacctagtagagatattattgcagactcaatggagactgtagtacaagctatgtcttatgatgcactggttacagtggtaggttgtgataaaaatatgccgggtgctcttatggcacagcttaggctagatagaccatctatactcgtctatgggggaactatagcaccaggatttcacgaagataaaaagctagatgtagtgtctgcttttgaagcttggggagaaaaagtagctggtagtattacagagcaagagtttaaaacggtggtaaaaaaagcctgtccaggtgctggtgcgtgtggtggtatgtatactgcaaacacgatggcaagcgcgattgaggcactagggatgagcttaccctatacaagttctaaccctgcagtgtcacctaataaaactgcggagtgtgctagagtaggagctgctttaagaaacctaatagaaaaagacataaaaccctcagacattgttactcgcaagtcactagagaatgcggtgagacttgtaaccgtacttggaggatctactaatgctgtgctgcactttctcgctatagcaaaggctgcacaagtatcatttacactagaagattttcaaaaaataagcgacaccacaccttttctagcagatcttaaaccatcaggaaaataccttatggaagatttacataatgtaggaggagtgccgggcgtattaaagtatatgctagagcaaggtatgttgcacggtgactgtatgaccgtaactggtaaaactattgcagagaatctagcagttgtagaccatcttcaggcacatcaagatgttattcattcggttgagaatcctattaaagagacgggacacattcgtattctttatggaaatattgcaagtgaaggatctgtggcaaaaattacaggtaaagagggattacattttcgcggaagcgcaagagtttacaacggtgagtatgctgcaaacgcgggtataggtgcaggagaggtgaaaaagggtgatgtagtagttatacgctacgaagggccacaaggaggaccgggtatgccagaaatgctcaaacctacagcggctattatgggtgctggcttaggtaaggatgtggcacttattacagatggacgtttttctggaggtacacacggctttgttgtggggcacattactccagaggctcaagtaggtggtgggattgcgcttatagaaaatggagataccattgtgattaacgctgagactaacacaattaatgttgagataagtgagagcgaactagaagcacgtaaaaagaactgggtagctccagagcttaaagtaaaacgtggctcactttataaatatgctcgtatggtctcatctgcgagtgagggatgcgtgacagacgagttctag

SEQ ID NO: 204 - protein, 559 aa, Cellulophaga sp.
MKELNKYSKAVTQDPTQPAAQAMLHAIGLTDEDFKKPLVGIASTGYEGNPCNMHLNNLALDIKKGVQTSDLVGLIYNTIGVSDGISMGTPGMRYSLPSRDIIADSMETVVQAMSYDALVTVVGCDKNMPGALMAQLRLDRPSILVYGGTIAPGFHEDKKLDVVSAFEAWGEKVAGSITEQEFKTVVKKACPGAGACGGMYTANTMASAIEALGMSLPYTSSNPAVSPNKTAECARVGAALRNLIEKDIKPSDIVTRKSLENAVRLVTVLGGSTNAVLHFLAIAKAAQVSFTLEDFQKISDTTPFLADLKPSGKYLMEDLHNVGGVPGVLKYMLEQGMLHGDCMTVTGKTIAENLAVVDHLQAHQDVIHSVENPIKETGHIRILYGNIASEGSVAKITGKEGLHFRGSARVYNGEYAANAGIGAGEVKKGDVVVIRYEGPQGGPGMPEMLKPTAAIMGAGLGKDVALITDGRFSGGTHGFVVGHITPEAQVGGGIALIENGDTIVINAETNTINVEISESELEARKKNWVAPELKVKRGSLYKYARMVSSASEGCVTDEF

SEQ ID NO: 205 - DNA, 1680 bp, Kordia algicida
atgaacaatctcaataaatacagcaaaacagtcacacaagatcctacgcaacctgcggcacaagccatgttgcatgccattggattaacgaaagaagactttttcaaacccatcatcggaattgcaagtacaggttacgaaggaaatccgtgcaacatgcacctaaacgatctggcaaaactggcaaaacaaggaacaaaaaatgaggaggttgtcggacttattttcaatacaattggcgtaagtgatggaatctccatgggaacaccaggaatgcgttattcattgccttcacgcgatatcattgccgattctatggaaacggtagtgcaagcaatgagttatgacggattaatcacggttgttggttgtgacaaaaacatgccaggcgcactaatggcaatgattcgcctaaatcgcccaagtatcttagtctatggcggaaccattgattctggttgtcacaacggaaaaaaactcgatgttgtttctgcttttgaagcttggggaagcaaagttgcaggaactatggacgaaacagaataccaaaacattgttgaaaaagcgtgtccaggtgctggtgcttgtggcggaatgtacaccgcaaacaccatggcttctgctatagaagcattgggaatgacattaccattcaattcatcaaatcctgcgttgagcgatgctaaaaaacaagaatcggttgcggcgggcgaagcaatgcgtgttttgttagaaaaagatatcaaaccatcagacattattactcgaaaatctttggaaaatgcagttcgtttagtaacaattttgggcggatcaaccaatgcagtattacacttcttagcaattgccagagctgcacaaattgatttcacactcaaagactttcaagaaataagcgatgaaacgccgtttttggcagacttaaaacctagtggaaaatacttaatggaagacgtacacgctgtcggcggaattcctgcggtattaaaatatttactcaaaaaaggattgcttcatggcgattgtttaacggttacgggaaaaacaatggcagaaaatttattagatgtcgatgacttaacagaaggtcaagatgtcatcaaacctgtggaaaatccaataaaaatatcaggacacttacgcatgctttatggaaacctagcaagtgaaggaagcgtggcaaaaatcacaggaaaagaaggtttaaaattctctggaaaagcaaaagtatttgaaggtgaatacgaagccaatgacggaattcgtgatggaaaagtgcaaaaaggagacgtcgtcgtcattcggtatgaaggaccaaaaggcggaccaggaatgccagaaatgctaaagccaacagcagcaatcatgggtgcaggtttaggaaaagatgttgcattaattactgatggacgcttttctggaggaacacacggttttgtcgtcggacacatcacgccagaagcacaagaaggcggaacacttgctttagtaaaagatggcgatatcattaccattgatgcagaaacgaatacgatacaattagaagtttcaaacgaagaacttcaagaacgtaaaaaacaatggaaagcacccgaactcaaatttgaacgcggtgtattatacaaatatgcaaaaacagtttcatctgcatccaaaggttgcgtaactgatgaattttag

SEQ ID NO: 206 - protein, 559 aa, Kordia algicida
MNNLNKYSKTVTQDPTQPAAQAMLHAIGLTKEDFFKPIIGIASTGYEGNPCNMHLNDLAKLAKQGTKNEEVVGLIFNTIGVSDGISMGTPGMRYSLPSRDIIADSMETVVQAMSYDGLITVVGCDKNMPGALMAMIRLNRPSILVYGGTIDSGCHNGKKLDVVSAFEAWGSKVAGTMDETEYQNIVEKACPGAGACGGMYTANTMASAIEALGMTLPFNSSNPALSDAKKQESVAAGEAMRVLLEKDIKPSDIITRKSLENAVRLVTILGGSTNAVLHFLAIARAAQIDFTLKDFQEISDETPFLADLKPSGKYLMEDVHAVGGIPAVLKYLLKKGLLHGDCLTVTGKTMAENLLDVDDLTEGQDVIKPVENPIKISGHLRMLYGNLASEGSVAKITGKEGLKFSGKAKVFEGEYEANDGIRDGKVQKGDVVVIRYEGPKGGPGMPEMLKPTAAIMGAGLGKDVALITDGRFSGGTHGFVVGHITPEAQEGGTLALVKDGDIITIDAETNTIQLEVSNEELQERKKQWKAPELKFERGVLYKYAKTVSSASKGCVTDEF

SEQ ID NO: 207 - DNA, 1680 bp, Flavobacteriales bacterium
atgagtcaattaaacaaatacagtaaaactgttacacaagatccaacgcagccagctgctcaagcaatgcttcatgctattggattaactaaagaagatttttataaacctattgtaggaattgcaagtacaggttacgaaggtaacccttgtaatatgcacctcaatgacctagcgaaattggtcaaagaaggcacaaagaatgaagatgtcgtcggcttaattttcaacacaattggtgtaagtgatggcatttctatgggaacaccaggaatgcgttactcattaccttcaagagatattattgcagattctatggaaactgtagtacaagccatgagttatgatggtttagtcactgtagttggttgcgacaagaatatgcctggagccttaatggctatgataagattaaatcgtccttcgattttagtttatggaggcacaattgattctggttgtcataatgggcaaaaattagatgttgtttctgcatttgaagcttggggaagcaaagttgcaggtactatgaccgaaaatgaataccaaaatatagttgaaaaagcatgtcctggagctggtgcttgtggaggtatgtacacagcaaacacaatggcttctgctattgaggctctaggtatgacattaccttttaactcttctaatccagccttaagtgatgcaaagaaagaagagtctgtaaaagctggagaagctttaagagttttactcgaaaaagatattaagccttcagatattataactagaaaatcacttgaaaatgcagtaagattagttaccatattaggtggctctacaaatgctgtattacactttttagccattgcaagagcagctcaaattgatttcacattaaaagattttcaagatataagtgataacactccattcttagcagatttaaaaccaagtggaaaatacttaatggaagatgtacatgctgtaggaggaattcctgcggtattaaaataccttcttaaaaaaggattaattcacggagattgtttaaccgttaccggaaagacaatagctgagaatttattagatgttgctgacttaaccgaaggtcaagacgtcatcaaacccatcgaagaaccaattaaaatttctggacacttaagaatgctctacggaaacctagccactgaaggtagtgttgcgaaaattactgggaaagagggcttaagttttaaagggaaagcaaaagtatttgaaagtgaatatgatgcaaacgatggcattagagatggaaaagtagaaaaaggtgatgtcgtagtcattcgatacgaaggtccaaaaggagggcctggaatgccagaaatgctaaagccaactgctgctattatgggagctggtttaggtaaagatgtagccttgattactgatggaagattctctggaggaactcacggttttgtcgttggacacatcacacctgaagcacaagaaggcggcactcttgcttttgttgaagatggagatattattacaattgatgccgaaaccaatacgatttcagtagaagtatctgaacaagaattacaaaaaagaagaaaaaattggaaagctccagatttaaaatttgaacgtggagtactttataaatatgcaaagacagtatcatcagcttcaaaaggctgtgttactgatgaattttaa

SEQ ID NO: 208 - protein, 559 aa, Flavobacteriales bacterium
MSQLNKYSKTVTQDPTQPAAQAMLHAIGLTKEDFYKPIVGIASTGYEGNPCNMHLNDLAKLVKEGTKNEDVVGLIFNTIGVSDGISMGTPGMRYSLPSRDIIADSMETVVQAMSYDGLVTVVGCDKNMPGALMAMIRLNRPSILVYGGTIDSGCHNGQKLDVVSAFEAWGSKVAGTMTENEYQNIVEKACPGAGACGGMYTANTMASAIEALGMTLPFNSSNPALSDAKKEESVKAGEALRVLLEKDIKPSDIITRKSLENAVRLVTILGGSTNAVLHFLAIARAAQIDFTLKDFQDISDNTPFLADLKPSGKYLMEDVHAVGGIPAVLKYLLKKGLIHGDCLTVTGKTIAENLLDVADLTEGQDVIKPIEEPIKISGHLRMLYGNLATEGSVAKITGKEGLSFKGKAKVFESEYDANDGIRDGKVEKGDVVVIRYEGPKGGPGMPEMLKPTAAIMGAGLGKDVALITDGRFSGGTHGFVVGHITPEAQEGGTLAFVEDGDIITIDAETNTISVEVSEQELQKRRKNWKAPDLKFERGVLYKYAKTVSSASKGCVTDEF

SEQ ID NO: 209 - DNA, 1704 bp, Psychroflexus torquis
ttgatttttgaaaatgaaacagatacaatggaactaaataagtatagcaaaaccgttactcaagatcctactcaaccagctgctcaagctatgctgcatgctataggtctaactaaagaagatttttttaagcctatcattggtattgctagtactggatacgaagggaatccttgtaatatgcatttaaacgatctcgctaaactcgctaaacaagggacagcaaatgaagatattataggtttaatatttaataccataggggtgagtgatggaatttctatgggcacaccaggaatgcgttactctctaccttctagggatatcatcgcagactccatggaaactgttgttcaagctatgagttatgatggtttaattactgtcgtaggctgcgataaaaacatgcccggtgcattaatagcgatgattcgactcgacagaccttgcattatgatttatggaggaaccatcgattctggttgtcataatggaaaaaaattggacgtggtttccgcttttgaagcttggggaagtaaagtggctggaaccatgcaagaagaagaataccaaagcattgtagaaaaagcgtgtcctggagctggtgcttgtggagggatgtatactgctaatacgatggcctcttctatagaagctttaggaatgactttaccttataattcttccaatccagcgcttagtccagaaaaaaaacaagagtctattaaagcaggtgaagctttgagagttttattggaaaaagacatcaaaccttcagatataattacaagaaaatctttagaaaatgccatacggttaattacaattttaggaggatctacaaatgctgttttacattttttagcaattgctagagccgctgaaattgatttcactttaactgattttcaaacgattagcgataatactccttttttagcagacttaaaaccgagtggtaagtaccttatggaagatttacatgaggtaggtggaattccagcagttttgaaatatttgcttaaaaaaggccttatttatggagactgcctaaccgttacaggaaaaactttagcagaaaatttacgtgatgtagaggatcttaaagaaggtcaggaggtcatcaaaccaatagaaagccctattaaaatctcaggacatctaagaatgctctttgggaatttagctgaagagggcagtgttgctaaaattacaggaaaagaaggtttaaaatttcgaggaaaggccaaggtttttgaaggggaatacaaagctaatgacggaattagagatggaaaagttcaaaaaggagatgtagtggttatccgttatgaaggccctaaaggaggtccaggtatgccagaaatgctgaaacctactgctgcaataatgggagcagggttaggcaaagatgtcgctttgattaccgatggaagattctctggaggaactcatggttttgtagttgggcatatcactccagaagcccaagaaggcggcacgattgcccttgttgaagaaggggattatatcactattgatgccgagacaaacagtatcaatttagaagtatctgatgaggagctcatcaaaaggaaaaaaaattggaaggcaccaaatttaaaatttaaacgaggtgttctttataaatatgcgagaatggttaattctgcatcaaaagggtgcgtaacagacgaattttaa

SEQ ID NO: 210 - protein, 567 aa, Psychroflexus torquis
MIFENETDTMELNKYSKTVTQDPTQPAAQAMLHAIGLTKEDFFKPIIGIASTGYEGNPCNMHLNDLAKLAKQGTANEDIIGLIFNTIGVSDGISMGTPGMRYSLPSRDIIADSMETVVQAMSYDGLITVVGCDKNMPGALIAMIRLDRPCIMIYGGTIDSGCHNGKKLDVVSAFEAWGSKVAGTMQEEEYQSIVEKACPGAGACGGMYTANTMASSIEALGMTLPYNSSNPALSPEKKQESIKAGEALRVLLEKDIKPSDIITRKSLENAIRLITILGGSTNAVLHFLAIARAAEIDFTLTDFQTISDNTPFLADLKPSGKYLMEDLHEVGGIPAVLKYLLKKGLIYGDCLTVTGKTLAENLRDVEDLKEGQEVIKPIESPIKISGHLRMLFGNLAEEGSVAKITGKEGLKFRGKAKVFEGEYKANDGIRDGKVQKGDVVVIRYEGPKGGPGMPEMLKPTAAIMGAGLGKDVALITDGRFSGGTHGFVVGHITPEAQEGGTIALVEEGDYITIDAETNSINLEVSDEELIKRKKNWKAPNLKFKRGVLYKYARMVNSASKGCVTDEF

SEQ ID NO: 211 - DNA, 1677 bp, Flavobacteriales bacterium
atggaattgaataaatacagtaaaaacgttacccaagaccccacacaaccagctgctcaagcaatgttgtatgccataggttttaaagatgaagattttaaaaaaccattagttggtatcgcaagtacgggatatgagggcaacccttgtaacatgcatttgaatgatttggccaaattggtcaaggacggcgtgaattcaaaggaaacggttggtttgattttcaatacaattggggtgagtgatggaatatccatgggaactcctggaatgcgtttttcattaccatcaagggatattattgccgattcaatggaaacggttgtccaaggaatgtcgtatgacgccttggtaacggtggtaggctgtgataaaaatatgccgggagcattaatggccatgttaagattgaataggccatcaatattggtatacggcggtacaattgcctctggatgtcataatgatagaaaattggatattgtttctgcttttgaagcttggggagaaaaagtggctggtaccatggaggagtctgagtataaaagtataataaggaaagcgattcctggggcaggtgcttgtggtggtatgtacacggcaaataccatggcttcagccattgaagctttgggaatgtcattgccttataattcttccaaccctgcagacaattatctcaaagagaatgaatgtattgaagcaggtaagcaaatgcgcgtacttattgagaaagatattaaaccactggacattgtaactcgtaagtcattggaaaatgcgattcgtttagttactatcatgggtggctcaacaaatgcagtattacatttcttggcaattgctagagccgcagatatagaatttacactacaagattttcaacatattagtgatacaacaccttttattgcagatttaaagccaagtggcaaatatttaatggaagatgtgcaccgtgtaggtggtataccggctgtattgaaatatttattgaaaaacggacttttacatggggattgtttaacggttactggcaagacattggctgaaaatcttgaaaatgtcccagatttagaagaggggcaagatgtaattatgcctttggacaaaccaataaaagcaaccggacatttacgcatgctttatgggaatctggcagaaaatggttcagttgcaaaaattacgggaaaagaaggtttggtgtttaaaggaactgccaaagtgtttaatagcgagtatgacgccaatgatggtattcgaactggattggtgaaaaagggtgatgttgttgtaattcgatatgaagggcctaaaggaggtcctggaatgccagaaatgttgaaaccaacagcagcaattatgggagctggtttaggaaaagaagtagccttgattacagatggtcgtttttcaggaggaacacacggttttgtagtaggacatatttcacccgaagctcaagaaggtggtacaattggtttggttaaaaatggtgacataattaccattgatgctgaaactaattcaatcaatgttgctgtttctgatgaagaattggcaaaacgaaagaccgaatgggtacaaccagaattaaaattcaaaaagggcgtgctttataaatatgcgcgttcggtttcatctgctgcggaaggttgcgtaacggatgagttttaa

SEQ ID NO: 212 - protein, 558 aa, Flavobacteriales bacterium
MELNKYSKNVTQDPTQPAAQAMLYAIGFKDEDFKKPLVGIASTGYEGNPCNMHLNDLAKLVKDGVNSKETVGLIFNTIGVSDGISMGTPGMRFSLPSRDIIADSMETVVQGMSYDALVTVVGCDKNMPGALMAMLRLNRPSILVYGGTIASGCHNDRKLDIVSAFEAWGEKVAGTMEESEYKSIIRKAIPGAGACGGMYTANTMASAIEALGMSLPYNSSNPADNYLKENECIEAGKQMRVLIEKDIKPLDIVTRKSLENAIRLVTIMGGSTNAVLHFLAIARAADIEFTLQDFQHISDTTPFIADLKPSGKYLMEDVHRVGGIPAVLKYLLKNGLLHGDCLTVTGKTLAENLENVPDLEEGQDVIMPLDKPIKATGHLRMLYGNLAENGSVAKITGKEGLVFKGTAKVFNSEYDANDGIRTGLVKKGDVVVIRYEGPKGGPGMPEMLKPTAAIMGAGLGKEVALITDGRFSGGTHGFVVGHISPEAQEGGTIGLVKNGDIITIDAETNSINVAVSDEELAKRKTEWVQPELKFKKGVLYKYARSVSSAAEGCVTDEF

SEQ ID NO: 213 - DNA, 1677 bp, unknown
  unidentified eubacterium SCB49
atggaattaaataaatatagtaaacgcgttactcaagacgattcacaacctgcagcaaaagctatgcttcatgctattggtttgagtaaagaagacttagataaaccatttgttggtattgcgagtacaggttatgaagggaatccttgtaatatgcatttaaacgatttagcgcttgaagtaaaaaaaggtacaaaaaataaagatttagtaggcctaatttacaataccattggtgtgagtgatggtatttctatgggaacacctggaatgagatattccctaccctctagagatgtaattgcagattcaatggaaacggtagtagaaggaatgtcttatgatgcacttgttacggtagtaggttgtgataaaaatatgcctggagctttaatggctatgttacgtactaaccgacctggcgttttagtttatggaggcaccattgcttctggatgtcataatggtaaaaaattagatgtcgtttctgcttttgaatcttgggggcaaaaagttgctggaaaaatagatgaaaaagaatatcaagatgtcattgaaaaggcatgtcctggtgcaggtgcttgtggtggtatgtataccgcaaacacaatggcatctgctatagaggcattaggaatggcattaccatataactcttctaaccctgctttaggaacagaaaaaaaagcagaatgcataaaagctggcgaagctgtccgtttactccttgaaaaagacattaaacctaaagatattgtcacaaaaaaagcattagaaaatgccatcaggttagtaacaataatgggaggatctacaaatgccgtgttacattttttagcgattgctagaaccactgatgttgaatttacattagaggatttccaaaaaatatctgataccactccttttttagcagatttaaaacctagtggtcagtacttaatggaagatgtccatgcggttggaggaacacctgctgttttaaaatacttattaaaaaatggcttattacatggagattgtctaactgtaacaggaaaaacattggctgaaaacctccaagatgtacccgatttattagaaaatcaaaaggttataaaatcaataaacaaccctattaaagagacagggcatttaagaatattaagaggaaatttatcaccagaaggtgctgttgcaaaaattacaggaaaagagggctttaaatttacaggtaccgcaaaagtttttgattctgaatatgacgccaatgatggcattagagatggtaaagtacaaaaaggcgatgttgtagttattagatatgaaggtcctaaaggtggtcccggaatgccagaaatgctaaagcctacagcagcaattataggagctggattaggtaatgatgtagctttaattacagatggaaggttttctggtggtacgcacggttttgtagttggtcatatttcgccagaagcacaagtaggcggtcctattgcttttgtacaaaacggagatgagataactatcgacgccattaaaaataccatagactttaatatttccgaagaagttttagaaaaacgtaaagcagcctggaaacaacccgatttaaagtataaaaaaggggttttatataaatatgccagaactgtatcatgtgcatctaaaggttgcgtaacagatgaattttaa

SEQ ID NO: 214 - protein, 558 aa, unknown
  unidentified eubacterium SCB49
MELNKYSKRVTQDDSQPAAKAMLHAIGLSKEDLDKPFVGIASTGYEGNPCNMHLNDLALEVKKGTKNKDLVGLIYNTIGVSDGISMGTPGMRYSLPSRDVIADSMETVVEGMSYDALVTVVGCDKNMPGALMAMLRTNRPGVLVYGGTIASGCHNGKKLDVVSAFESWGQKVAGKIDEKEYQDVIEKACPGAGACGGMYTANTMASAIEALGMALPYNSSNPALGTEKKAECIKAGEAVRLLLEKDIKPKDIVTKKALENAIRLVTIMGGSTNAVLHFLAIARTTDVEFTLEDFQKISDTTPFLADLKPSGQYLMEDVHAVGGTPAVLKYLLKNGLLHGDCLTVTGKTLAENLQDVPDLLENQKVIKSINNPIKETGHLRILRGNLSPEGAVAKITGKEGFKFTGTAKVFDSEYDANDGIRDGKVQKGDVVVIRYEGPKGGPGMPEMLKPTAAIIGAGLGNDVALITDGRFSGGTHGFVVGHISPEAQVGGPIAFVQNGDEITIDAIKNTIDFNISEEVLEKRKAAWKQPDLKYKKGVLYKYARTVSCASKGCVTDEF

SEQ ID NO: 215 - DNA, 1689 bp, Gramella forsetii
atggataaaacagcaatgaacaacaaatatagtagtacaataacacaaagtgattctcaacctgcctcacaggcgatgcttcacgctataggattaaataaagaagatctcaaaaaaccttttgtgggaattgggagtaccggttacgaagggaatccctgtaatatgcaccttaatgaccttgctaaagaggtgaaaaaaggaactcagaatgccgatttaaacggacttattttcaatacaataggcgttagtgatgggatttccatgggaacgccgggaatgcgattctcactgccttccagagatctaatcgcagattctatggaaactgttgtaggaggaatgtcttacgatggcctggttactgtagtgggttgcgataagaatatgcccggtgccttaatggctatgttgagactgaacaggccttctgtgctggtgtatggcggaacgatcgcttccggttgccataatggtaaaaaactggatgtggtgtctgcatttgaagcctggggctcaaaagtttcaggggatatgcaggaagaagaatatcagcaggtaattgaaaaagcctgtccgggggcaggagcctgtggagggatgtatactgcaaatacaatggcctcctctatcgaagctttagggatgagtctgccgttcaacagttccaatcctgcaaccggacctgagaaaactcaggaaagtgtaaaagcaggggaggcgatgaaatatttgctggagaatgatctaaaaccaaaagatatagtgaccgcaaaatcactggagaatgcaattcgactattaacggtgcttggtggttctaccaatgccgtacttcattttcttgcgatagcaaaagctgcagagatcaattttggattaaaagattttacaagaatatgtgaggaaacgcctttcctggcagatttgaagcctagcgggaaatacctgatggaagatattcacaggattggaggaatcccggctgtgatgaaatatatgcttgaaaaaggactgcttcatggcgaatgtatgacagttaccggaaaaacgattgccgaaaatcttgaaaatgtaaagccattacctgacgatcaggatgtaattcaccctgtcgaaaaacctatcaaagctaccggacacatcagaattttatacggaaatctggcttctgaaggctccgttgccaaaataacgggaaaagaaggattggaatttcaaggaaaagcaagagtgtttaatggtgaatttgaagctaacgaagggatttcttcgggcaaggttcaaaaaggggatgtggtcgtcattcgctatgagggtcctaaaggaggacctggaatgccagaaatgctgaaaccaacttcggccattatgggcgccggactagggaaaagtgtagcccttatcaccgacggaaggttctcgggaggaactcatggctttgtggtgggacacattactcctgaggctcagcaaggcggactcattggtctgttgaaggatggtgacgagataagtattaatgccgagaaaaatactattgaggcacatctttcagcagaagaaataaatagaagaaaagaagcctggaaagctcccgctttaaaggtgaacggaggagtactctataaatacgcaaaaacggtagcatcagcttcagaaggctgcgtaacagatgaattttaa

SEQ ID NO: 216 - protein, 562 aa, Gramella forsetii
MDKTAMNNKYSSTITQSDSQPASQAMLHAIGLNKEDLKKPFVGIGSTGYEGNPCNMHLNDLAKEVKKGTQNADLNGLIFNTIGVSDGISMGTPGMRFSLPSRDLIADSMETVVGGMSYDGLVTVVGCDKNMPGALMAMLRLNRPSVLVYGGTIASGCHNGKKLDVVSAFEAWGSKVSGDMQEEEYQQVIEKACPGAGACGGMYTANTMASSIEALGMSLPFNSSNPATGPEKTQESVKAGEAMKYLLENDLKPKDIVTAKSLENAIRLLTVLGGSTNAVLHFLAIAKAAEINFGLKDFTRICEETPFLADLKPSGKYLMEDIHRIGGIPAVMKYMLEKGLLHGECMTVTGKTIAENLENVKPLPDDQDVIHPVEKPIKATGHIRILYGNLASEGSVAKITGKEGLEFQGKARVFNGEFEANEGISSGKVQKGDVVVIRYEGPKGGPGMPEMLKPTSAIMGAGLGKSVALITDGRFSGGTHGFVVGHITPEAQQGGLIGLLKDGDEISINAEKNTIEAHLSAEEINRRKEAWKAPALKVNGGVLYKYAKTVASASEGCVTDEF

SEQ ID NO: 217 - DNA, 1677 bp, Robiginitalea biformata
atgaacctgaacaaatacagtaaaaacgtcacacaggaccccacccaaccggcagcgcaggccatgctttatgccattggcctgaccgaggaggaccttgaaaaacccctgatcgggattgccagcaccgggtatgaaggcaacccgtgcaacatgcacctgaacgatctggcgctgcacgtgaaggaaggcgtgaaccgctccgatctggtagggctgattttcaatacgatcggggtgagtgacgggatatccatgggaacctacgggatgcgttattccctcccttcccgggatattattgccgattccatggagaccgtggtccaggcgatgaactacgacggcctggtaactgtagtgggctgtgacaagaacatgcccggggcgctgatggcgatgatccgcctgaaccgcccctccgtaatggtttacgggggaaccattgcatccggttgcctgaacaaccggaaactcgatgtggtatcggcttttgaggcctggggccagaaagtggccgggaatatgcaggaggaggaatacaaacaagtaatccagaacgcctgcccgggagctggtgcctgtggcgggatgtatacggccaacacgatggcatcggctatcgaagccctggggatggccctgccttacaactcttcgaacccagccaccggttcggaaaagcaggaagattgcacccgcgccggccaggcggtgcgcaccttgctcgaaaaagatatcaagccgctcgacattattacaaaaaagtccctggagaatgccatccgcctcgtagtggtgatgggggggtccacgaatgccgtcctgcacttcctggccattgccaaggcagcgcgcgtaccgtttaccctggacgatttccagcggatcagtgacgaaacgccctttttggcagacctgaagcccagcggcaaatacctgatggaagatgtccaccgggtgggcggcgtgcctgccgtccttaaattcctgctcgctgaaggcatgctccacggggattgcctgacagttactggaaaaacccttgccgagaacctaaaggatgtcccggatctggaagccggtcaggaggttatccggcccctttccgacccgatcaagaaaaccgggcacctgcgtatcctgtacgggaacctcgcacccacaggttcggttgccaaaatcaccgggaaggagggactccggttccagggacccgcccgcgtatttgaggacgaatttgaagcaaaccggggcataggcgaaggcaaagtttcccggggggatgtggtagtcatccgctacgaaggtccccagggtgggcctggtatgcccgaaatgctcaagcccaccagtgccatcatgggggccggcctgggcaaggatgtggccctgatcaccgatggccgcttttcgggtggtacccacggatttgtagtggggcatgtaacacccgaagcacaggccggaggcccgattgccctgctccgggacggggacatcatcaccatcgacgccgaagccaatacgctttcggtagacctgagcgacgaggagctcaaccggcggcgggcagcctggaaggcccctgaactaaaggtgaagcggggcagcctgtacaaatatgccaaaacggtttcatcggcctctgaaggctgtgttaccgatgaaatttga

SEQ ID NO: 218 - protein, 558 aa, Robiginitalea biformata
MNLNKYSKNVTQDPTQPAAQAMLYAIGLTEEDLEKPLIGIASTGYEGNPCNMHLNDLALHVKEGVNRSDLVGLIFNTIGVSDGISMGTYGMRYSLPSRDIIADSMETVVQAMNYDGLVTVVGCDKNMPGALMAMIRLNRPSVMVYGGTIASGCLNNRKLDVVSAFEAWGQKVAGNMQEEEYKQVIQNACPGAGACGGMYTANTMASAIEALGMALPYNSSNPATGSEKQEDCTRAGQAVRTLLEKDIKPLDIITKKSLENAIRLVVVMGGSTNAVLHFLAIAKAARVPFTLDDFQRISDETPFLADLKPSGKYLMEDVHRVGGVPAVLKFLLAEGMLHGDCLTVTGKTLAENLKDVPDLEAGQEVIRPLSDPIKKTGHLRILYGNLAPTGSVAKITGKEGLRFQGPARVFEDEFEANRGIGEGKVSRGDVVVIRYEGPQGGPGMPEMLKPTSAIMGAGLGKDVALITDGRFSGGTHGFVVGHVTPEAQAGGPIALLRDGDIITIDAEANTLSVDLSDEELNRRRAAWKAPELKVKRGSLYKYAKTVSSASEGCVTDEI

SEQ ID NO: 219 - DNA, 1677 bp, Tenacibaculum sp.
atggaattaaataaacatagcaaaagattaacccaagacgaatctcaaccagcttctcaagccatgttgtatgcagtaggtttatcagaagaagatatgagcaaagcccaagttggtattgcaagtacaggttatgatggtaatccatgtaatatgcatctaaacaatttagctgcagaagttaaagtagaaagtaaaattgctggtttagttgggttaggttttaatactattggagtttcagacggaatttctatgggaacttctggtatgaattattctttagcttccagagatataattgcagattcaatagaaactgtaatgaatgctcaaagttatgatgccttagtttctgtggtaggttgtgacaaaaatatgccaggagctgtaattgcaatgttacgtttaaataggccatcaattatgatgtatggaggtacaattgcctctggtagttataaaggtaaaaaattaaatattgtatctgcctttgaagctttaggtcaaaaagtagctggagaaatagatgagaatgaatacaaagaaattataaaaagagccattccaggagcaggtgcttgtggaggtatgtatactgcaaatacaatggcttctgcaatagaatgtatgggttttgctttgccttataattcttctattccagcagaaaatccaaataaactatctgaagcagaaagaacagctttagctattaaaaacttattagagttagatttaaaacctttagatatcatttctaaaaagtcgttagaaaatgctgttgctttagtaaatgctttgggtggatctacaaatgcagttttacactttttagctatagcacatgcagcagaaatagattttactttagaagattttcaaaaagtatcagatagaacgcctttaattgcagatttgaaaccatcaggaaaatatttaatggaagatgttcatggagttggaggtacgcctgcaattatgaaatatttattggataatgggtatttgcatggagattgcttaactgttacaggtaaaactttagcagaaaacttggcagatgttaaagcaatggagtttgaagctcaagatgttatttatccaaaagataaagctttaaaaacgtcaggaaacattcaaatcatttatggaaatctagcaacagaaggtgcagtagctaaaatttctggaaacgaaggcttgttgtttgaaggtaaagctgtggtttacgatggtgagcaagcagcaaatacaggtatttctaatggtgaagtagaaaaaggtgatgtagttgttattagatatgtggggccaaaaggtgggccaggaatgccagaaatgttaaagccaacttctttaattatgggagcaggtttaggtaaatctgtagctttaataacagatggacgtttttctggaggtacacatggttttgttgtggggcatattacaccagaagcacaatcaggaggagctattgggcttttagaaacaggtgataaaattagaattagtgcagaagacaactcaataaatgtgcttatttctgatgaagagttagagaaaagaagagcaaattgggtggctcctgctttaaaacataaaaaaggaattttatacaagtacgcaaaatctgtagcctctgcatctaaaggatgtgttactgatttataa

SEQ ID NO: 220 - protein, 558 aa, Tenacibaculum sp.
MELNKHSKRLTQDESQPASQAMLYAVGLSEEDMSKAQVGIASTGYDGNPCNMHLNNLAAEVKVESKIAGLVGLGFNTIGVSDGISMGTSGMNYSLASRDIIADSIETVMNAQSYDALVSVVGCDKNMPGAVIAMLRLNRPSIMMYGGTIASGSYKGKKLNIVSAFEALGQKVAGEIDENEYKEIIKRAIPGAGACGGMYTANTMASAIECMGFALPYNSSIPAENPNKLSEAERTALAIKNLLELDLKPLDIISKKSLENAVALVNALGGSTNAVLHFLAIAHAAEIDFTLEDFQKVSDRTPLIADLKPSGKYLMEDVHGVGGTPAIMKYLLDNGYLHGDCLTVTGKTLAENLADVKAMEFEAQDVIYPKDKALKTSGNIQIIYGNLATEGAVAKISGNEGLLFEGKAVVYDGEQAANTGISNGEVEKGDVVVIRYVGPKGGPGMPEMLKPTSLIMGAGLGKSVALITDGRFSGGTHGFVVGHITPEAQSGGAIGLLETGDKIRISAEDNSINVLISDEELEKRRANWVAPALKHKKGILYKYAKSVASASKGCVTDL

SEQ ID NO: 221 - DNA, 1677 bp, Polaribacter irgensii
atggaattaaacaaacatagcaaaagattaacacaagatgaatctcaaccggcatcacaagcaatgttgtacgctgtaggtttaacagatgaggacatgcagaaggcgcaaattggtattgcaagtactggatatgacggaaatccttgtaatatgcatttaaatcatctaaaagaagaggttaaagtagagtgtaatattgcgggtttagtcggtttagggttcaatacaattggggtgtcagatggaatttctatgggaacttcaggcatgaattattctttagtttcaagagatatcatagcagactctatcgaaacggttatgaatgcacaaagttacgatgcagtaattgctattgtgggttgtgataaaaatatgccaggatcagtgattgccatgctgcgtttaaatcgccctgcgataatgatgtatggcggctcgactgcatcgggaaattacaaaggaaaaaagttaaatattgtttccgcttttgaggctttaggtcaaaagatgtctggagaaattgaagaagaagagtatcgagaaataattaagagggccattccaggcgctggagcgtgtggtggtatgtacactgcaaatacaatggcttctgcgattgaatgtatggggttctcattgccttataattcttcaattccggcagaaaatccgaataaattgtctgaagcggaaagaactgccttggcgattaaaaacttactagaattagatttaaaacctttagatattatttctaagaaatctttagaaaatgccattacccttgtaaatgcgttaggagggtcaacaaatgccgtcttgcatttcttagcaattgcgcacgctgcagatattgagtttactttagaggattttcaaagagtgagtgacagaacaccattaattgcagatttgaaaccatcaggaaaatatcttatggaagatgtgcataatattggaggcacacctgcgatcatgaaatatttattagaaaatgactatttgcacggggattgtttgacggttacaggaaaaacattggctgagaatttagcaaatgttaaggcgatggaatttgaagagcaagatgtgatttacccaaaagagaacgcattaaaatcatcaggaaatattcaaataatttatggaaacctagcaactgaaggagcagtagcaaaaatatctggaaacgaagggctactttttgaaggaaaagctgtcgtgtatgatggtgagcaagctgcaaatacagggattacaaatggagaggtagaaagaggagatgtcgtcgttattagatacgtgggtcctcgaggaggtccaggaatgccagaaatgctgaaacctacgtccttaattatgggtgcaggtttaggaaagtctgtagcattaattacagatggaagattttctggaggaacacatggctttgttgttggacacattacaccagaagcacaatcgggaggaaccattgggattttaaaaactggcgatacaattagaattagtgcagaagataattctattaatgttttaatttctgaggatgaaattgcagcaagaaaagtaaaatgggttgcacccgcactaaagcatacaaaaggaattttgtataaatatgcaaaaacagtagcatccgcatctaaaggatgtgtaacagacttataa

SEQ ID NO: 222 - protein, 558 aa, Polaribacter irgensii
MELNKHSKRLTQDESQPASQAMLYAVGLTDEDMQKAQIGIASTGYDGNPCNMHLNHLKEEVKVECNIAGLVGLGFNTIGVSDGISMGTSGMNYSLVSRDIIADSIETVMNAQSYDAVIAIVGCDKNMPGSVIAMLRLNRPAIMMYGGSTASGNYKGKKLNIVSAFEALGQKMSGEIEEEEYREIIKRAIPGAGACGGMYTANTMASAIECMGFSLPYNSSIPAENPNKLSEAERTALAIKNLLELDLKPLDIISKKSLENAITLVNALGGSTNAVLHFLAIAHAADIEFTLEDFQRVSDRTPLIADLKPSGKYLMEDVHNIGGTPAIMKYLLENDYLHGDCLTVTGKTLAENLANVKAMEFEEQDVIYPKENALKSSGNIQIIYGNLATEGAVAKISGNEGLLFEGKAVVYDGEQAANTGITNGEVERGDVVVIRYVGPRGGPGMPEMLKPTSLIMGAGLGKSVALITDGRFSGGTHGFVVGHITPEAQSGGTIGILKTGDTIRISAEDNSINVLISEDEIAARKVKWVAPALKHTKGILYKYAKTVASASKGCVTDL

SEQ ID NO: 223 - DNA, 1698 bp, Pedobacter sp.
atgtcaacaacaccagaattaaaccgctatagcaaaacattcactcaagatcctacacaacctgccgcacaggccatgttgtatgggattggcctaacaaaagaggacctcgacaaagcccaggtaggcattgccagcatgggttacgatggaaacacctgtaacatgcacctgaacgacctcgctcaggtggtaaaaaaaggcgtctgggacaacggaatggttggcctgaccttcagcaccatcggtgtgagtgatggaatgtctaatggtacagacggaatgcgttactccctggtatccagagatgtcatcgccgattctattgagaccatctgtggcggacagtattatgatggtgtcatcaccattcctggatgtgacaaaaatatgccgggatccatcattgccatgggacgtctgaaccgcccctcgatcatggtatatggtggaagtatccactccggaaactataaaggcaaagccctgaacattgtttctgcttttgaagcattgggtcagaaacttgccggtaacatcgaagaagaagattatcaaggcatcatccgccatacctgccctggtgcgggtgcatgtggggggatgtataccgcaaatactatggcctctgcaattgaagcaatgggcatgagtttgccttatagctcctcctaccctgctaccagtcaggagaaaaaggatgaatgtatcaatgctgccaaagcaatccgtgttttgctggagagaaacattcttccaagtgacatcatgaccgagaagtcattccacaacgccatcgtaacggtgatggtactaggtggatctaccaatgccgtactccacctgattgcaatggccaaatctgtaggcctgaacctgaagatcgatgatttccaggacgtaagtaacaatactccggtacttgccgatttaaaacctagtggtacttacctgatggaagacctgcatgaaattggtggtgttcctgcagtattaaaatatctattgaaagaaggactgttgcatggcgactgtatgacggtaacgggtaaaacccttgctgagaatgtggctgatgccgtagacctggatttcgatcagcaaaagatcatcttcccggtcagcaacccgctaaaaacaactggtcacctgcagatcctgtatggcaacattgctcaaaaaggatcagtagcaaaaatcagtggtaaagaaggcgagaaatttgaaggccctgcacgtgtatttgacggggaaaaatcgttgatcgcaggaatcctgagtggacgtgtacgccagggtgatgtggtcgtgatcagacaggtaggccctaaaggagctcctggaatgcctgaaatgctgaaaccgacatctgccatcattggcgccggactgggtaaatcggttgccctgatcactgacggaaggttctccggaggtacacatggtttcgtagtgggacacatcactcctgaagcatgggatggtggaaacatcgcctttgttaatgatgatgacatgattaccattgatgcagtcaacaataccattaacctgaagatctctgatgaggaaatggctaaacgtaaggcagaatggaaacagttgcctccgccagtgaaaagcggtgtattgtacaaatacatcaagcaggttagtgatgccagcgaaggatgtgttactgacgcctacacacattaa

SEQ ID NO: 224 - protein, 565 aa, Pedobacter sp.
MSTTPELNRYSKTFTQDPTQPAAQAMLYGIGLTKEDLDKAQVGIASMGYDGNTCNMHLNDLAQVVKKGVWDNGMVGLTFSTIGVSDGMSNGTDGMRYSLVSRDVIADSIETICGGQYYDGVITIPGCDKNMPGSIIAMGRLNRPSIMVYGGSIHSGNYKGKALNIVSAFEALGQKLAGNIEEEDYQGIIRHTCPGAGACGGMYTANTMASAIEAMGMSLPYSSSYPATSQEKKDECINAAKAIRVLLERNILPSDIMTEKSFHNAIVTVMVLGGSTNAVLHLIAMAKSVGLNLKIDDFQDVSNNTPVLADLKPSGTYLMEDLHEIGGVPAVLKYLLKEGLLHGDCMTVTGKTLAENVADAVDLDFDQQKIIFPVSNPLKTTGHLQILYGNIAQKGSVAKISGKEGEKFEGPARVFDGEKSLIAGILSGRVRQGDVVVIRQVGPKGAPGMPEMLKPTSAIIGAGLGKSVALITDGRFSGGTHGFVVGHITPEAWDGGNIAFVNDDDMITIDAVNNTINLKISDEEMAKRKAEWKQLPPPVKSGVLYKYIKQVSDASEGCVTDAYTH

SEQ ID NO: 225 - DNA, 1680 bp, Flavobacteria bacterium
atggaattaaataaatatagtaaaacaataacacaagatccttctcaacctgcttctcaagcaatgttatatggaattggtttaactgaagaacaactagcaaaaccttttataggaattgcttcaatgggttatgatggaaatacttgtaatatgcatttaaatcatttagcagctttaattaaaaaagaagttaatgctaatgatatggtgggtttaattttcaacacaattggtattagtgacggtattactaacggaactgatggaatgcgttattctctagtaagtagagaaattattgcagatagtattgaaagtgttgtttcaggtcattactatgatggtgtaatttctattcctggttgtgataaaaatatgccaggaagtattattgcaatgggaagattaaatcgtccatcgataatggtttatggtggtacaattgcaccaggaaaataccaaggtaaagatttgaatattgtttcggcatttgaagcattaggagaaaaaattgcgggtactatttctgaagaagactataaaggaattataaagaattcatgtccaggtgcaggagcttgtggcggcatgtatacggcaaatacaatggctattgctattgaagcattaggaatgagcttaccttattcaagttcaaatcctgctataagtcatgataaaatagaagaatgtgaatctgccgctggatatttaaaattattattagaaaaaaatatttgtccaaaagacattatgacgtttgaagcatttgaaaatgctattaccgttttaattgctctaggaggaagtacaaatgccgttttgcatatgattgcaatggcaaaaagtgttggagtagctataagtcaggataattttcaacgattaagcaatacaactccattaattgccgattttaaaccgggtggaaattatttaatgcaaaacctacatgaaaaaggtggtgtgccaatggttttaaaatatttgctttctaaaggaatgttacatggaaattgtattacggtaacaggtaaaactttagcagaaaatttagaagcagtaatagatattgattttaacgatcaaaatattattcgtcagatagagaatccaataaaaactacagggcatcttcaaattttatatggaaatcttgctttaaaaggttccgtagcaaaaataacaggtaaagaaggcgaattttttaaaggtccagctcgtgtttttgatggtgaaaaagaattaataaaaggtatcgaagataaaaaaataaaagctggcgatgtcgtagttatacgatatgtaggtccgaaggggggacctggaatgcccgaaatgctaaagccaacatcagccttaattggtgctggtttaggaaaaagtgttgcattaattaccgatggtcgttttagtggaggaactcatggttttgtagtaggtcatatttcacctgaagcttatgatggaggtacaattgctttagttgaagatgaagatattatagaaattaatgctgttgataataccattcatttacatgttggtgatgaagaattagcgaatagaaaaagtaaatggaatcaaccaaaattaaaagtaactaatggtgtgttattaaagtatgcaaaattagttacagatgcttcaaatggttgtgtaaccgatgaatattag

SEQ ID NO: 226 - protein, 559 aa, Flavobacteria bacterium
MELNKYSKTITQDPSQPASQAMLYGIGLTEEQLAKPFIGIASMGYDGNTCNMHLNHLAALIKKEVNANDMVGLIFNTIGISDGITNGTDGMRYSLVSREIIADSIESVVSGHYYDGVISIPGCDKNMPGSIIAMGRLNRPSIMVYGGTIAPGKYQGKDLNIVSAFEALGEKIAGTISEEDYKGIIKNSCPGAGACGGMYTANTMAIAIEALGMSLPYSSSNPAISHDKIEECESAAGYLKLLLEKNICPKDIMTFEAFENAITVLIALGGSTNAVLHMIAMAKSVGVAISQDNFQRLSNTTPLIADFKPGGNYLMQNLHEKGGVPMVLKYLLSKGMLHGNCITVTGKTLAENLEAVIDIDFNDQNIIRQIENPIKTTGHLQILYGNLALKGSVAKITGKEGEFFKGPARVFDGEKELIKGIEDKKIKAGDVVVIRYVGPKGGPGMPEMLKPTSALIGAGLGKSVALITDGRFSGGTHGFVVGHISPEAYDGGTIALVEDEDIIEINAVDNTIHLHVGDEELANRKSKWNQPKLKVTNGVLLKYAKLVTDASNGCVTDEY

SEQ ID NO: 227 - DNA, 1677 bp, Flavobacterium psychrophilum
atgaacacaataaacaaatacagtaaaaccataacgcaagacgaaacccaaccagcagcacaagccatgctttatggaatagggttaacggaagcagatatgtataaagcacaagtaggaattgtaagtacaggttatgaaggtaatacttgcaatatgcacttgaacgatttagccaaagacgtaaaatttggagttgcatctgaaaatttagtcggattaatatttaatactataggcgtaagcgatggtatctctaacggtacagatggtatgcgattttcattggtatctcgagacataattgcagactctatagaaacagtggttagtgcacaatggtacgatgccgttttagccgtagtgggatgtgataaaaatatgcctggatctgtcatggctatgggaagactaaatcgacctgctataatgatatatggtggtagtattcattctggaaaatggaaaggagaatccttaaatattgtgtcggcttttgaagctttgggaaaaaaatttaacaatacaataaccccagaagattttaaaggtgttataaaaaacgcttgtccaggtgcaggtgcttgtggcggaatgtacaccgcaaacaccatggcttccgcaattgaagctttgggaatgagcttaccatatagttcgtctaatccagctttgagccaagaaaagaaacaagaatgtttagatgcaggcaaagcaatccgagttttattagaaaaagacatcaaacctaaagacatcatgaccaaaaaagccttcgaaaatgcaatgacgatggtggtggttcttggtgggtctacaaatgccgttttgcatttaatagccatggcacattcagtagatatagaattaaccctgcaagacttccaaaaaacaagtaacaacattcctgttttagcagatttaaaaccaagcggaaaatacctcatggaagatttacacgcagtgggaggggttcctgcggttatgaaatatttgctagaaaacaagctgttacacggtgattgcttaacagtaacagggaaaacagtagccgaaaatttagcaaatatccctagtttacatcaaggacaaactgtttttcttcctctaaaaacgccactaaaagccacaggacatttgcaaatcctttacggaaacctagcgccagaagggagtgttgcaaaaataagcggcaacgaaggtgatttctttgaagggaaagccaaagtttataatgatgaatataccgtgattgatggcgtaaaaaacggagaggttgcctctggagatgtagttgtaattagatattgcggaccaaaaggaggaccgggaatgccagaaatgctaaaacctacttccgcaataatgggagctggtttaggaaaaaatgtagcattaataaccgacggaagattctcggggggaactcatggttttgtagtggggcatattacacctgaagcttacgacggaggaaccattgcgctagtaaaagatggtgatacaattaccattaatactaaaaataacaccattcaattaaaagttagcgaagaagaattaaccaaaagaaaatccgaatggaaacaacctaaacttaaagctaccaaaggtgttttgtataaatatgcccaatgtgtttcaagtgcatctaaaggttgtgtaaccgataattaa

SEQ ID NO: 228 - protein, 558 aa, Flavobacterium psychrophilum
MNTINKYSKTITQDETQPAAQAMLYGIGLTEADMYKAQVGIVSTGYEGNTCNMHLNDLAKDVKFGVASENLVGLIFNTIGVSDGISNGTDGMRFSLVSRDIIADSIETVVSAQWYDAVLAVVGCDKNMPGSVMAMGRLNRPAIMIYGGSIHSGKWKGESLNIVSAFEALGKKFNNTITPEDFKGVIKNACPGAGACGGMYTANTMASAIEALGMSLPYSSSNPALSQEKKQECLDAGKAIRVLLEKDIKPKDIMTKKAFENAMTMVVVLGGSTNAVLHLIAMAHSVDIELTLQDFQKTSNNIPVLADLKPSGKYLMEDLHAVGGVPAVMKYLLENKLLHGDCLTVTGKTVAENLANIPSLHQGQTVFLPLKTPLKATGHLQILYGNLAPEGSVAKISGNEGDFFEGKAKVYNDEYTVIDGVKNGEVASGDVVVIRYCGPKGGPGMPEMLKPTSAIMGAGLGKNVALITDGRFSGGTHGFVVGHITPEAYDGGTIALVKDGDTITINTKNNTIQLKVSEEELTKRKSEWKQPKLKATKGVLYKYAQCVSSASKGCVTDN

SEQ ID NO: 229 - DNA, 1674 bp, Flavobacterium johnsoniae
atggaattaaataagtacagcaaaaccatcactcaagatcaaacacagcctgcggcgcaagcaatgttgtatggaattggtttaactgaagaagatttaaaaaaagcacaagttggtattgtcagcatgggttatgatggtaatacttgcaatatgcacttaaatgatttagcaaaagatgttaaaaaaggtgtttgggatgctggtctggtcggacttatttttaataccattggtgtaagtgacggaatttctaacggtacagaaggaatgcgttattcattagtttctcgtgatgtaatcgcagattctattgaaactgtagccggtgcacaatggtacgatagtattattgcaattcctggctgcgataaaaatatgcctggagcattaatcgcaatgggaagattaaaccgtccgtcaatgatggtttatggaggatctatccactcaggaaaatggaaaggtgaatctctaaacatcgtttctgcttttgaagctttaggaaaaaaagtaaaaggcgaaattactccggaagattttaaaggtgttattcaaaatgcttgtcctggagctggtgcctgcggtggtatgtatactgcaaacactatgtcttctgcaattgaagcattaggtatgagtatgccttacagttcttctaaccctgctttgagtcaggaaaaaagagacgaatgtattgctgccggagaagctattaaagttttattagaaaaagatattaagccaagagatattatgactcgtaaagctttcgaaaatgctattacaattgtagcagttttaggaggttctacaaacgcagttatgcacttaattgcaatggcacactctgttggtattacaattactcttgatgattttcaggcaattaacgacagaacacctgttcttgccgatatgaaaccaagtggtaaatatatgatggaagacattcacgaagtgggaggtattccgggtgtaatgaaatatttattgaaagtgggacttatccacggagattgtttaacagtaactggaaaaacagttgctgaaaacttagcttctacaccggatttacaagacggacaagaagtaattcatgaaattcaaaaagcgttaaaaccaacaggaaatattcaggttttatacggaaaccttgcttctgaaggagctgtggcaaaaatcagcggaaaagaaggggaatatttcgaaggaccagctgttgtatttgaaggggaatttgaagtaattccaggcttgcaggccggaaagattaaaccaggtaatgtcgtcgtcattagaggttgtggaccaaaaggtggtccgggaatgcctgaaatgctaaaaccgacatctgccattattggtgcaggattaggaagcagctgtgcacttattacagacggcagattctccggaggttcacacggattcgtggtaggacacgtaacaccagaggcttatgatggaggtggtattgcactagtaaaagatggagatttaattgctatcgatgctgtaaaaaatacaatcgacctgaaaatatctgacgaagaatttgcagctcgtaaagcggcttgggttcaaccagcgctaaaagttgacagaggggttttacttaaatacgcaagatcggtttctagtgcttcaacaggctgtgttaccgataattaa

SEQ ID NO: 230 - protein, 557 aa, Flavobacterium johnsoniae
MELNKYSKTITQDQTQPAAQAMLYGIGLTEEDLKKAQVGIVSMGYDGNTCNMHLNDLAKDVKKGVWDAGLVGLIFNTIGVSDGISNGTEGMRYSLVSRDVIADSIETVAGAQWYDSIIAIPGCDKNMPGALIAMGRLNRPSMMVYGGSIHSGKWKGESLNIVSAFEALGKKVKGEITPEDFKGVIQNACPGAGACGGMYTANTMSSAIEALGMSMPYSSSNPALSQEKRDECIAAGEAIKVLLEKDIKPRDIMTRKAFENAITIVAVLGGSTNAVMHLIAMAHSVGITITLDDFQAINDRTPVLADMKPSGKYMMEDIHEVGGIPGVMKYLLKVGLIHGDCLTVTGKTVAENLASTPDLQDGQEVIHEIQKALKPTGNIQVLYGNLASEGAVAKISGKEGEYFEGPAVVFEGEFEVIPGLQAGKIKPGNVVVIRGCGPKGGPGMPEMLKPTSAIIGAGLGSSCALITDGRFSGGSHGFVVGHVTPEAYDGGGIALVKDGDLIAIDAVKNTIDLKISDEEFAARKAAWVQPALKVDRGVLLKYARSVSSASTGCVTDN

SEQ ID NO: 231 - DNA, 1713 bp, Lactococcus lactis
atggaattcaaatataacggaaaagttgaatcaatagagctcaataagtattcaaaaacattgacacaagacccaacacagccagcgacccaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagttgctgacgatgagattgctagacgacgtgccaattatcaaaaacctgctcctaaagcaacgcgtggggttcttgctaaatttgctaaactcacgcgcccagccagtgaaggctgtgtgactgatttatag

SEQ ID NO: 232 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 233 - DNA, 1686 bp, Psychromonas ingrahamii
atgtcagaaataaataagtattcaaaaacagtgacgttagatgaatcacaaccggcttcacaggccatgctttatgctattggtttgaaagaagaggatatgaaaaaagcgcaagtgggtattgtttcaacaggatgggaaggaaatccatgcaatatgcacttaaacgaatttgctaaagacgtgaaaaaaagtgtgaacgcagctgatttggtgggattaatctttcacacaatcggagtgagtgatggtatttcaaacgggactaccgggatgaagtactctttagtgtctcgtgagatcattgctgattctattgaaacggttgtaagtgcgcaattttatgatgcgattgttgccattgtaggatgtgataaaaatatgcccggtgcaatgatggcattgtcgcgtttaaatcgtccgggaatattggtttatggcggttcggttaaagctggaaaatggaaaggtgaagacttgaatatcgtttctgctttcgaagcttatggaaaaaaattacagggtgttatctcccatgaagattataaaggggtaattcaaaatgcgatcccgggtccgggtgcttgtggtggaatgtatacggcaaatactatgtcttcagctattgaagcgttaggcatgagtttgccttactcttcatcgaacccggcggttagcgatgacaaaaaaagagaattaacaacagtgggtgatgcagttaaaaacctgctggaaaaagatattaaaccaaaagatattatgaccaaaaaagcgttcgagaatgccttaagaattattatgattttagggggctctaccaatgcaactttacatatgattgcaatggcccgatcatcaggtgttgacttgagtttagatgatttccaaaagatggcagataaaacgccattattggcaaatttaaaaccttccggggaattcctaatgcaagacttacatgaaatcggcgggatccctgcagtcatgaaatacttattggctgaaggtttattacatggggattgtttgaccgttacaggtaacaccattgctgaaaacttagctgatttacccggccttcctgatgatcaggacattatcagacctttgtctaaccccttgaaagaaactggccacttacagattctttatggaaacttggcacctgaaggttcagttgcaaagattacaggtaaagaaggcgaagtattcgaaggcccggcaagagtttatgaagatgaattttcagcaataaaaggtatcggagacgaagtgcaaaaaggtgaagttatcgttatccgttattcaggaccaaaaggtgcgcctggcatgccagaaatgctaaaaccaacttcagctgtaatgggggcgggtcttggaaaagacgtggcattaattacagatggcagattctccggaggttctcatggttttgttgttggacacgtgacgccagaggcatcggaaggtggattgattgccctggtccaaaatggagacatgatccgaattgattctgttactaacaaattggaattgaaagtcgatcaggctgaaatcaacaagcgtaaagctgcttggataaaaccagcttacagagcgacaaatggtgtactaagaaagtatatcgccacggtaaaatctgcctctctaggatgtgttaccgatgaaatagacgaactgtag

SEQ ID NO: 234 - protein, 561 aa, Psychromonas ingrahamii
MSEINKYSKTVTLDESQPASQAMLYAIGLKEEDMKKAQVGIVSTGWEGNPCNMHLNEFAKDVKKSVNAADLVGLIFHTIGVSDGISNGTTGMKYSLVSREIIADSIETVVSAQFYDAIVAIVGCDKNMPGAMMALSRLNRPGILVYGGSVKAGKWKGEDLNIVSAFEAYGKKLQGVISHEDYKGVIQNAIPGPGACGGMYTANTMSSAIEALGMSLPYSSSNPAVSDDKKRELTTVGDAVKNLLEKDIKPKDIMTKKAFENALRIIMILGGSTNATLHMIAMARSSGVDLSLDDFQKMADKTPLLANLKPSGEFLMQDLHEIGGIPAVMKYLLAEGLLHGDCLTVTGNTIAENLADLPGLPDDQDIIRPLSNPLKETGHLQILYGNLAPEGSVAKITGKEGEVFEGPARVYEDEFSAIKGIGDEVQKGEVIVIRYSGPKGAPGMPEMLKPTSAVMGAGLGKDVALITDGRFSGGSHGFVVGHVTPEASEGGLIALVQNGDMIRIDSVTNKLELKVDQAEINKRKAAWIKPAYRATNGVLRKYIATVKSASLGCVTDEIDEL

SEQ ID NO: 235 - DNA, 1677 bp, Microscilla marina
atgacagttttgaacaaatacagccgacgaattactcaggatgtaacccaaccagcctctcaagcaatgctgtatggcatagggcttactaaagaggatatgagcaagcctcaaataggcatagtaagtactggttatgagggcaatacctgcaacatgcacctcaatgatctggccttggaaaccaaaaaaggtactaaagaagcagacttggtagggttggtattccatactataggcgtaagcgacggaatatctaacggtaccgaaggaatgcgtttttcgttgccttcacgcgacattatcgccgactcgatagagactgtagtgcaggctcaatggtacgatgggatacttgctgtagtgggttgcgacaaaaacatgccgggagctatgatggctctggcgcgtttgaaccgtcctggactgcttgtttacggcggaagcatcaggtcaggctgtcacaaaggtcaaaaactcaatattgtgtctgcctttgaagcactcggacagcgttttaacggaagtttgaatgaagaagattatcaaggaattatccaaaactcttgccctggtgcaggagcttgtggcggtatgtatactgccaacacgatggcaacagtgatagaagctattggattgggcttaccttatggagcctctaatcccgcccaaagccctgaaaaacaacaagaatgtatagatgcgggcaaagctatgagaaagctgctcgaagaggacatcaaacccctcgacatattgaccaaaaaagcttttgaaaatgccttgacaatgatcatggtcatgggaggctctaccaatgcggtgctgcacatgattgccattgccaaagctgctgaggtggatctaagcctggaagattttcaacgtatcagcgacaaaactccttatttggcaaatctcaagcctagtggaaagtacttgatggaagacttgcacaccattggtggcacccctgctgtaatgaagctattgctggacgagggattgctacacggtgattgtttgacggtaacgggcaaaacgcttgctgagaatcttgctaacattgctccggtaaaagacgatcaggacgtgctgttcccaataagccaacctctaaaacctcagggacatttacaagtgttatttggcaacctggccacacaaggggcagtagctaaaattacgggcaaagagggagaaaaatttgaaggtactgccaaggtgtacgacggagagtttgaggctatcaaaggtattcaggacggagaagtaaaagctgggcacgtggtagtcattaggtacgaaggccccaagggtggtccgggaatgcctgaaatgctcaagcctacctctgcaataatgggtgccgggctgggcaatagcgtggcattgattacagatggtaggttttcgggtggttcacacggttttgtagtgggacacgtgtgccctgaagcacaggaaggtggcttgattgccttgcttaaggatggcgatcgaatcacgattgatgcggtagacaaccaaatggtggcgcacttatcagaggaagaaatagcccaacgacgcgcccaatggcaagcaccagaatcgcgctttacccgtggaattttaggcaaatatgcccgtactgtttcgtcggcctcggagggctgtgtaacggatgaatag

SEQ ID NO: 236 - protein, 558 aa, Microscilla marina
MTVLNKYSRRITQDVTQPASQAMLYGIGLTKEDMSKPQIGIVSTGYEGNTCNMHLNDLALETKKGTKEADLVGLVFHTIGVSDGISNGTEGMRFSLPSRDIIADSIETVVQAQWYDGILAVVGCDKNMPGAMMALARLNRPGLLVYGGSIRSGCHKGQKLNIVSAFEALGQRFNGSLNEEDYQGIIQNSCPGAGACGGMYTANTMATVIEAIGLGLPYGASNPAQSPEKQQECIDAGKAMRKLLEEDIKPLDILTKKAFENALTMIMVMGGSTNAVLHMIAIAKAAEVDLSLEDFQRISDKTPYLANLKPSGKYLMEDLHTIGGTPAVMKLLLDEGLLHGDCLTVTGKTLAENLANIAPVKDDQDVLFPISQPLKPQGHLQVLFGNLATQGAVAKITGKEGEKFEGTAKVYDGEFEAIKGIQDGEVKAGHVVVIRYEGPKGGPGMPEMLKPTSAIMGAGLGNSVALITDGRFSGGSHGFVVGHVCPEAQEGGLIALLKDGDRITIDAVDNQMVAHLSEEEIAQRRAQWQAPESRFTRGILGKYARTVSSASEGCVTDE

SEQ ID NO: 237 - DNA, 1689 bp, Cytophaga hutchinsonii
ttgattattgtgagtacagaattaaataaaataagtaaacgtttaacccaggatccatctcagcccgcatctcaggcaatgatgtatggagctgggtttacagacgaggatatgaaaaagccaatcgttggtattggcagtacaggtttcgatggtaacacatgtaacatgcacttaaatatccttgccggacaagttaaaggcagtattacgcgtggcggtatggttggacttggtttcaacacgatcggcgtaagtgatgggatttcaatgggtacagaagggatgcgtttctctcttgtatcacgcgacgtaattgcggattcaattgaaacaatttgtgaagctcattactacgatgcgttggtaaccgttgtaggttgtgataaaaacatgcctggcgcacttattgcaatggctcgcttgaatcgcccgtcaatcatggtatacggcggtacaattcactcaggtcactacaaaggcgaaaaactaaacatcgtttcagcttttgaagcattgggtaaaaaagtagccggcacaatcactgaagaagattaccagggtgtaattaaaaatgcatgtccgggtgcgggtgcctgtggtggcatgtacacagcaaacacaatggcatctgcaattgaagcaatgggattaacacttccttattcttcaacggcacctgcaacaagcgaaaagaaaaaggcagaaacattggcgcttggcaaagcaatgatgcatctgctggagaaagatatcaagccgcgtgatatcatgacattcgaggcatttgaaaatgctatccgtgtgatcctggtattgggtggttctacaaatgcggtaatgcacttaattgcaattgcaaaagctgcgggtgttaaattaacgatcgatgattttcaacgcatcggtaatacaacaccgttactggcagatttaaaaccaagcggcaagtatatgatggaagatatggacgctattggcggcgtaccttctgtaatgcgtttgttggcaaaacataatttacttcatttagattgtatgactgtaacaggtaaaactgttggagagaatttaaaagaagctcaggatcttcctacggatcaggatctgatgtatgcatgggaaaacccgatcaaacaaacaggtcacttacagattctgtatggcaatcttgcaccacaaggttctgtggcaaagattaccggtaaagaaggaacatactttgaaggtcctgcacgcgtgtacgactctgaagaggctgtaaacaaaggtttagaggctaatgaagtaaaatcaggtgaagtaattgtaatccgttatgttggtccgaaaggcggcccgggcatgcctgaaatgttgaagccaactgctctattaatgggcttaggtttaggcaacgaatgtgccttaatcacagacggacgtttctctggcggtacacatggtttcgtagttggccacattacaccggaagcaacagaagggggtatgattggccttgtaaaaaatggcgacatcatccgtattgatgcagtaaacagagtcctagaagttaaaatttccgaggaggaagtaaccaaacgccgtgcggcatgggtaaaacctgcgccaagagctacatccggcgtgttatataaatacatgaaattagtatcttctgcatctgagggatgcgttaccgataattaa

SEQ ID NO: 238 - protein, 562 aa, Cytophaga hutchinsonii
MIIVSTELNKISKRLTQDPSQPASQAMMYGAGFTDEDMKKPIVGIGSTGFDGNTCNMHLNILAGQVKGSITRGGMVGLGFNTIGVSDGISMGTEGMRFSLVSRDVIADSIETICEAHYYDALVTVVGCDKNMPGALIAMARLNRPSIMVYGGTIHSGHYKGEKLNIVSAFEALGKKVAGTITEEDYQGVIKNACPGAGACGGMYTANTMASAIEAMGLTLPYSSTAPATSEKKKAETLALGKAMMHLLEKDIKPRDIMTFEAFENAIRVILVLGGSTNAVMHLIAIAKAAGVKLTIDDFQRIGNTTPLLADLKPSGKYMMEDMDAIGGVPSVMRLLAKHNLLHLDCMTVTGKTVGENLKEAQDLPTDQDLMYAWENPIKQTGHLQILYGNLAPQGSVAKITGKEGTYFEGPARVYDSEEAVNKGLEANEVKSGEVIVIRYVGPKGGPGMPEMLKPTALLMGLGLGNECALITDGRFSGGTHGFVVGHITPEATEGGMIGLVKNGDIIRIDAVNRVLEVKISEEEVTKRRAAWVKPAPRATSGVLYKYMKLVSSASEGCVTDN

SEQ ID NO: 239 - DNA, 1764 bp, Rhodopirellula baltica
ttgaccctttcaaggtgttgccacccatcttcggccgctttcccctgccaaaacgatctcatgaccgcgtctcagcctgaatccgattccaatgcactgaacaagtacagcagcaagatcacccagccgaaaagccagggtgcgtcgcaggcgatgctttacgccaccggcatgtcctcggaggatatgaacaagcctcaagtcggcatcggcagcatgtggtacgagggcaacagctgcaacatgcacctgctcgatctcgcagcggatgttaaagctggagtcaccgacgccggaatggtcggaatgcgtttcaacaccatcggtgtctcggacggcatctcgatggggaccgacgggatgagcttctcactgcaaagtcgcgacctgatcgccgactcgatcgagacgatcatgggggcgcagtggtacgacgcgttgatcaccctgcccggctgcgacaagaacatgcccggctgtttgatggcgatgggacgtctgaaccgtccttccatcatggtctacggtggaacgattaaacctggcagctaccgcgacgagaagctggacatcgtcagcgcgttccagtgctacggccagttcatcgcgggacaaatcagcgaagaagaacgcagtgaaatcgttcgccgcagttgcccaggtgcgggagcatgcggcggcatgtacaccgccaacacgatggccaccgcaatcgaagccttgggcatggccctgccctactccgccagcatccctgcagagcatccagaaaagaaagaggaatgcaaacgtgccggtttggccatcctcgaactgttgaagaaggacatcaagcctcgcgacatcatgactcgcggtgcattcgaagacgcgatggtgacattgatggcactgggcggcagcaccaacgcggtgcttcacttgatcgcgatggctcgcagcgtcgatgtgccactgacgattgaagacttccaatcggtcagcgaccgcacacctttcttggccgacctgaaacccagcggcaagttcgttcaagaagacctgcacagcgtcggtggcacgcccgcggtgatgaagtacttgctcgaaaagggcatgatcaaaggcgagcacatgaccgtcaccggcaagactctcgcggagaacctggccgatttgcctggtttgaagaccggccaaaagatcgtgtcgacggtcgaagagccgatcaaaaaatcgggtcacattcgaatcctgaaaggatcactggccacggaaggcgcggtcgcgaaaatcactggcaaagaaggtctgcagttcagcggaccggctcgtgtctatgacaatgaggaattgatgctcgccgctttggaacaaaagcagattcaaaagggtgacgtcgttgtgatccgctacgaaggtcccaagggcggacccggcatgcctgagatgttgactccaaccagtgccatcatgggtgctggtttgggaagcgacgtcgcgatgctgactgacggccgtttcagcggcggtagtcacgggttcatcgtggggcacatcactcccgaagcacaagttggtggtccgatcgcattgatcgaagatggagacacgatcacgattgatgccgaaaccaactcgttggacttagaagtcgatgcggctgaattggaagcccgccgatccaagtggaccgcaccgccactgaaagccacccgcggaacgctctacaagtacatcaagtgcgtgaagagcgccagcgaaggctgcgtcaccgacgagtga

SEQ ID NO: 240 - protein, 587 aa, Rhodopirellula baltica
MTLSRCCHPSSAAFPCQNDLMTASQPESDSNALNKYSSKITQPKSQGASQAMLYATGMSSEDMNKPQVGIGSMWYEGNSCNMHLLDLAADVKAGVTDAGMVGMRFNTIGVSDGISMGTDGMSFSLQSRDLIADSIETIMGAQWYDALITLPGCDKNMPGCLMAMGRLNRPSIMVYGGTIKPGSYRDEKLDIVSAFQCYGQFIAGQISEEERSEIVRRSCPGAGACGGMYTANTMATAIEALGMALPYSASIPAEHPEKKEECKRAGLAILELLKKDIKPRDIMTRGAFEDAMVTLMALGGSTNAVLHLIAMARSVDVPLTIEDFQSVSDRTPFLADLKPSGKFVQEDLHSVGGTPAVMKYLLEKGMIKGEHMTVTGKTLAENLADLPGLKTGQKIVSTVEEPIKKSGHIRILKGSLATEGAVAKITGKEGLQFSGPARVYDNEELMLAALEQKQIQKGDVVVIRYEGPKGGPGMPEMLTPTSAIMGAGLGSDVAMLTDGRFSGGSHGFIVGHITPEAQVGGPIALIEDGDTITIDAETNSLDLEVDAAELEARRSKWTAPPLKATRGTLYKYIKCVKSASEGCVTDE

SEQ ID NO: 241 - DNA, 1683 bp, Blastopirellula marina
atgtccgccccgctcaacaagtacagcagccgcgttacccagccaaaaagccagggcgcgtcgcaggccatgctttacggaaccggcatgaccgacgccgacatggacaaagcgcaggttggcatcgccagcatttggtacgagggcaacacgtgcaacatgcacctgaatcagctctcggaagtggtgaaaaaaggggtggtaggcgccgacatggtcgggatgcggttcaacacgatcggcgtgagcgacggcatctcgatggggaccgaagggatgagcttctcgctccaatctcgcgacctgatcgccgactcgatcgaaacggtcatgggcggtcagtggtacgacggactgatcgcgctgccgggctgcgacaaaaacatgccgggatgtttgatcgcgatggggcgtttgaaccgtccgtcgatcatggtctacggcggtacgatcaaaccgggccacaccagcaagggagagaagctcgacatcgtctcggctttccagtgctacgggcaattcctctcggaaggaatcaccgaagaagaacgcaaagaaatcgtgcacaaagcttgtcctggagcgggcgcttgcggcggcatgtacaccgccaacacgatggcgacggcgatcgaagcgatgggcatgacgctgccttacagcagcagcattccggccgaagatccggcgaagcagcaagaatgcatcgacgccggcaaagcgatgcgctacttgctggagaaagatattaagccgcgcgacatcatgacccgtgatgcgtttgaaaacgcgatggtcacggtgatggcgctcggcggttcgaccaacgccgtgttgcacttgatcgcgatggctcgcgcggtggatgtcgacctgtcgatcgacgacttccaaacggtcagcgatcgcgtccctttcttggccgatctgaagccgagcggcaagtttgtgcaagaagatctgcactcgatcggcggtacgccggccgtcctgaagtatctgctggccgaaggcttcttgaagggggactgtatgacggtgaccggcaagacgctggccgaaaacatcgccgatcttcccggcttgaaagaaggccagaagatcgtccacccactgtcggacccgatcaagtcctccggtcacatccagatcttgaagggcacgctggcccccgaaggcgccgtcgccaagatcaccggcaaagaaggactccgctttcaagggccggccaatgtctttgatagcgaagaagacatgttgcacgcgctggaagacaagaagatcaaaaagggagacgtcgtcattattcgctacgaaggtcccaagggaggccccggcatgccggagatgctgactccgacctcggcgattatgggggccggtctcggcagcgatgtcgcactgctgaccgatggccgcttctccggcggctcgcacggtttcatcgttgggcatatcacgcctgaggcgcaagacggaggcccggtcgcgctcgttcaaaatggcgacatcgtcacgatcgacgccgacaccaactcgattgacgtcgacgtgccggccgatgagatggcgaaacgcttggccgcttggaaggctccggcctacaaagcgacccgcggcacgctttacaagtacatcaagaatgtgaaaagcgcttcagaaggttgcgtgaccgacgaataa

SEQ ID NO: 242 - protein, 560 aa, Blastopirellula marina
MSAPLNKYSSRVTQPKSQGASQAMLYGTGMTDADMDKAQVGIASIWYEGNTCNMHLNQLSEVVKKGVVGADMVGMRFNTIGVSDGISMGTEGMSFSLQSRDLIADSIETVMGGQWYDGLIALPGCDKNMPGCLIAMGRLNRPSIMVYGGTIKPGHTSKGEKLDIVSAFQCYGQFLSEGITEEERKEIVHKACPGAGACGGMYTANTMATAIEAMGMTLPYSSSIPAEDPAKQQECIDAGKAMRYLLEKDIKPRDIMTRDAFENAMVTVMALGGSTNAVLHLIAMARAVDVDLSIDDFQTVSDRVPFLADLKPSGKFVQEDLHSIGGTPAVLKYLLAEGFLKGDCMTVTGKTLAENIADLPGLKEGQKIVHPLSDPIKSSGHIQILKGTLAPEGAVAKITGKEGLRFQGPANVFDSEEDMLHALEDKKIKKGDVVIIRYEGPKGGPGMPEMLTPTSAIMGAGLGSDVALLTDGRFSGGSHGFIVGHITPEAQDGGPVALVQNGDIVTIDADTNSIDVDVPADEMAKRLAAWKAPAYKATRGTLYKYIKNVKSASEGCVTDE

SEQ ID NO: 243 - DNA, 1692 bp, Planctomyces maris
atgtcagccgattcgcaacccgttttgaacaagtacagttcccgtatcacacagccccgttcgcagggtgcctcgcaagccatgctctacgccaccggcatgagcgaagaggatatgaacaaggcccaggtcggaatttccagcgtctggtacgaaggcaattcctgcaacatgcacctcaacaaactggctgccaaggtcaaagagggcgtcgaagccgccgatctggttggcctgcggtttaataccatcggtgtgagcgacgggatttccatgggcaccgacggcatgtcctattcgctgcagtcccgcgacctgatcgccgacagtatcgaaacagtcacctgtgcccagtggtacgatgccaacatttcgctgcctggctgtgataagaacatgcctggctgcctgattgccatgggacgatttaaccgcccctcgatcatggtttacgggggaacgattgctcccggctgtctgaataatcagaagctggacattgtctccgcatttcagtcttacggcgaatacctggctggtacgatcacagatgaaacccgaaaagaaatcgtacagaaaagctgtccgggcgctggtgcctgcggcggcatgtataccgccaacacgatgtcgtctgccatcgaagctctggggatgtcactcccttacagttcttccattcctgcagagcatcccgataaactcgatgagtgtatccgcgctggtgccgccatcaggaaactgctggaactggatctgaaaccccgcgacatcatgacccgcgaggctttcgaaaatgcgatggtactgattgtcgcactggggggatcgaccaacgccgtgctgcacatgctggccatcgcccgttctgtcggcctggaactgactattgatgacttccagtccgtcagcgatcgtattcctttgctggccgatttcaaacccagtggtaaatacgtgatggctgacctgcaggagattggcgggacaccagccgtgatgaaatacctgctggaaaaaggcctgatcaacggcgactgcatgacggtcacgggaaaaacagtggccgaaaacctggcagaactaccgggcctcaaagagggtcaggatatcattcacgctgtcgaaaacccgatcaagccgaccggtcacctgcagatacttaaaggcaacctggctccgacaggtgccgtcgccaagatcaccggtaaggaaggcctggtcttcgaagggaccgccaacgtcttcgattccgaagaggacatgctcaaagccctcgaagacaagcagattcaaaaaggcgatgtgatcatcatccgctacgaaggccccaaagggggaccagggatgcccgaaatgctgaccccgacttccgccatcatgggagccggcctgggtaaggatgttgccctgctgaccgacggtcgtttttctggtggttcacacggctttatcgtcggacatatcactcctgaagcacaggaaggcggtccaatcgccctggtcaaaaatggcgacaaggtcattatcgacgccgacaaaaatcgactggagatggatgtcagtgatgcagagctcgaagaacgtcgcaaagcctggacggcccctccgtttaaatacacgcggggtacactttacaaatatatcaagaatgtgaaatccgcttctgaaggttgtgtgaccgacgagtaa

SEQ ID NO: 244 - protein, 563 aa, Planctomyces maris
MSADSQPVLNKYSSRITQPRSQGASQAMLYATGMSEEDMNKAQVGISSVWYEGNSCNMHLNKLAAKVKEGVEAADLVGLRFNTIGVSDGISMGTDGMSYSLQSRDLIADSIETVTCAQWYDANISLPGCDKNMPGCLIAMGRFNRPSIMVYGGTIAPGCLNNQKLDIVSAFQSYGEYLAGTITDETRKEIVQKSCPGAGACGGMYTANTMSSAIEALGMSLPYSSSIPAEHPDKLDECIRAGAAIRKLLELDLKPRDIMTREAFENAMVLIVALGGSTNAVLHMLAIARSVGLELTIDDFQSVSDRIPLLADFKPSGKYVMADLQEIGGTPAVMKYLLEKGLINGDCMTVTGKTVAENLAELPGLKEGQDIIHAVENPIKPTGHLQILKGNLAPTGAVAKITGKEGLVFEGTANVFDSEEDMLKALEDKQIQKGDVIIIRYEGPKGGPGMPEMLTPTSAIMGAGLGKDVALLTDGRFSGGSHGFIVGHITPEAQEGGPIALVKNGDKVIIDADKNRLEMDVSDAELEERRKAWTAPPFKYTRGTLYKYIKNVKSASEGCVTDE

SEQ ID NO: 245 - DNA, 1680 bp, Algoriphagus sp.
atgaccctgaaaaaacacagttgggaaatcagcgacaattcggagcatccggctgggatggctatgttgtatgccaccggaatgagcgataaaaagatgaaacagccatttgtagggatagcgagttgcggctatgaaagtaatccctgcaatatgcatttgaacgactttgccggtctgatcaaagcttcttcacaagagcaagatctgaccggtttagtttttaataccattggtatttctgacggaaccacgatgggaaccttggggatgcgttattcactggtttctagggagataattgctgattctatagagtcttttatcatagggcattcatttgatgcttgtatttctgttgcaggatgtgacaagaatatgcctggtgcattgatggggatgatccgtactaacagaccttctattttggtgtatggaggaacgatagcctctggacattataagggagaaaagctaaatatcgtttcggcatttgaagcctttggaaagcgagtgaatggaaacatttctgatgaagattatgatggtgtcatcagaaacgcatgtccaggaaaaggagcttgtggaggtatgtatactgccaataccatgtcttcagcaattgaagcgatgggaatgtcattgccttactcctcttcttatccggcaaactctccagaaaaattgagggagtgtggagaagtgaataaatatatgagaatccttttagaaaaggatttgaaacctagtgatatcatcactagaaaaagtattgaaaatgcagtaaccgtagcaattgccttaggtggtagtaccaatgcggtaatgcatatcattgcgatcgcccgaactgccggtgtagattttaccattgaggattttaaagcaatcaatgcaaaaactccaatgattggtgatttcaaaccttctggaaaattcatgatggaagaccttcacgaacaaggtggacttcctgcctttatgaagtatatgttgcagaatgggttcattcatggagattgcttaactgtgactggaaagacggttgcagaaaaccttgagaatattgaacctgtgactccatcgatggtgaatgttattcatcctttggaaacgccgataaaagcaacgggtcatttatgtgtgctttcaggaaatcttgctccagaaggagcggttgccaaaattacaggtaaagaaggaagttcttttacaggacctgcacatgtttttgactcagagcaggatgccaatgatgctatcagagatcataaaattgagaagggtgaagttattgtcattcgaaatatcggacccaaaggtggtccaggaatgcctgaaatgttgaagcctacttctatgattataggagctggtttaggatcagacgttgccttaattactgatggaagattttccggaggaacacacggatttgtggtagggcacgttacaccagaagcgtttagcggaggacctatcggattggtcagaaatggagatatcatcacgatagatgctgataacttacagctgagcgttgcgatttctgaagaggagtttgaagaaagaaagaaaacttggaaacgaaaagaaatttctgatttgcaagggactttgaaaaaatacaataaacttgttgccactgcatctgaaggttgcgtgacagataaattctaa

SEQ ID NO: 246 - protein, 559 aa, Algoriphagus sp.
MTLKKHSWEISDNSEHPAGMAMLYATGMSDKKMKQPFVGIASCGYESNPCNMHLNDFAGLIKASSQEQDLTGLVFNTIGISDGTTMGTLGMRYSLVSREIIADSIESFIIGHSFDACISVAGCDKNMPGALMGMIRTNRPSILVYGGTIASGHYKGEKLNIVSAFEAFGKRVNGNISDEDYDGVIRNACPGKGACGGMYTANTMSSAIEAMGMSLPYSSSYPANSPEKLRECGEVNKYMRILLEKDLKPSDIITRKSIENAVTVAIALGGSTNAVMHIIAIARTAGVDFTIEDFKAINAKTPMIGDFKPSGKFMMEDLHEQGGLPAFMKYMLQNGFIHGDCLTVTGKTVAENLENIEPVTPSMVNVIHPLETPIKATGHLCVLSGNLAPEGAVAKITGKEGSSFTGPAHVFDSEQDANDAIRDHKIEKGEVIVIRNIGPKGGPGMPEMLKPTSMIIGAGLGSDVALITDGRFSGGTHGFVVGHVTPEAFSGGPIGLVRNGDIITIDADNLQLSVAISEEEFEERKKTWKRKEISDLQGTLKKYNKLVATASEGCVTDKF

SEQ ID NO: 247 - DNA, 1677 bp, Candidatus Sulcia muelleri
atggcgattaatacatttagtattaaattaactaaaaatagtactttacctgctgcacaagcaatgctgtatgctactgggttaaaagaatatgattttaatcaagctcaagttggcatagttagtaattggtatgaaggtaatccatgtaatattcatttacatattattagtaataatataaaatcatctataaaaaaaaatggaatggtggggtttaaatttaatactataggtattagtgatggtatgtctatgggaacatctggaatgagatattctttaccatcaagagaattaatagctgatagtatagaaagtgttgttaaaactcaacattatgatggattaataggaattccaggatgtgataaaaatatccctggaatagttatggcaatgttacgtattaatagaccttctatattagtatatggaggtagtatatcatcaggatattataatggtaaaaaattaaatatagtttctgcttttgaagctttaggagaaaaaaatataggtaaaatttcagaattagaatataaaaatataattaaacatgcttgtcctggtccaggagcttgtggaggaatgtatacagctaatacaatggcttcttgtcttgaagcaatgggaataacaattccatattcatcttcatcattagctaatagtagctttaaaaaaaaagaatgtattaatataggttattatataaataatatattaaaaaataatattaaaccattggatattattacttataaatctataaaaaatgctataactctagcaatagcattaggaggatcaacaaatttagtaatacatattttagcaatagctaaaactgctaatttagatctaaaattagatgatattcaaaatatcaataataatgttccaattatagctaatttaaaaccaagtggagattttttaatggaagatatacaatctatgggaggaattcctataattataaaatatttattaaaagaaggatatatagaaggagactgtattactgtaacaggaaacacaataaaaaaaaatttagaaaatatacctgatctttcttttaaagaaaaaattatatatcctttattaaatcctataaaaaaaaatgggcatatacgtattttatatggtaatatagccccttatggagctgttgctaaaattactggaaaagaaggtgatattttttcaggatttgcacaagtttttaattcagaaaactctgctaataaagcaataattaataataaaattaaagaaggagatgtaatagtaattagatatgtaggtcccagaggaggtcctggaatgcctgaaatgcttaaacctacttcttacataatgggggctaatttaagtaaaaaaattgctttaataactgatgggagattttcaggaggatctcatggatttgtagtaggtcatattactccagaggctcaaaatggaggattaattgctttaatagaaaatggagatattataataattgatgcaataaagaatactataacattaaaaatatcaaaaaaagaaataaaaaatagaaaaaaaacacccttgcgagtgcgaggtaaagtaaattcaggttatttatataagtatacaaaaactgtatcatctgcttataatggatgtgtaacagataaattgtaa

SEQ ID NO: 248 - protein, 558 aa, Candidatus Sulcia muelleri
MAINTFSIKLTKNSTLPAAQAMLYATGLKEYDFNQAQVGIVSNWYEGNPCNIHLHIISNNIKSSIKKNGMVGFKFNTIGISDGMSMGTSGMRYSLPSRELIADSIESVVKTQHYDGLIGIPGCDKNIPGIVMAMLRINRPSILVYGGSISSGYYNGKKLNIVSAFEALGEKNIGKISELEYKNIIKHACPGPGACGGMYTANTMASCLEAMGITIPYSSSSLANSSFKKKECINIGYYINNILKNNIKPLDIITYKSIKNAITLAIALGGSTNLVIHILAIAKTANLDLKLDDIQNINNNVPIIANLKPSGDFLMEDIQSMGGIPIIIKYLLKEGYIEGDCITVTGNTIKKNLENIPDLSFKEKIIYPLLNPIKKNGHIRILYGNIAPYGAVAKITGKEGDIFSGFAQVFNSENSANKAIINNKIKEGDVIVIRYVGPRGGPGMPEMLKPTSYIMGANLSKKIALITDGRFSGGSHGFVVGHITPEAQNGGLIALIENGDIIIIDAIKNTITLKISKKEIKNRKKTPLRVRGKVNSGYLYKYTKTVSSAYNGCVTDKL

SEQ ID NO: 249 - DNA, 1650 bp, Candidatus Carsonella
atgaaatcaaaattaataacaaaatggccaataaaagcagcaaatagagccatgttgcgtgcagttggatataacgattatgattttaataaatttcaagttggaattgcatcaacttggagtaatataacaccttgtaataatcatatcaatgtattagctaaagcagttgaatatggagtaaattcaaaattttgtaaaggaacaatatttaatacaataacagtatctgatggaatatcaaatggtaattttggaatgaaatattcattactatcaagagatataatttcaaattcaatagaagttgttggcaaagcacaaaattttgatggtattatttctattggaggatgtgacaaaaatattcctggttgtattattggaatgtgtaatttagaaattccttcaatttttatatatggtggtacaattttaccaggcaaaaatagaacagatattgtctctgtttttgaatctttgggtaaattttataataaaactattaatgaaaaagaattgttaaatattgaaaaaaactccattattggatctggatcatgtagtggaatgtatacagcaaattcaatggcaattgttgcagaatgcctaggaattagcttaccaaactcttctattcaaaatgcgcaatcaattaataaaattgttaattgtattaattctggtaaattaataaaaatattgttagaaaataatattacaataaaaaaaattattaataaagaatctattttaaattctataaaagtaatttcattattaggtggatcaacaaattgtttaattcatttattagcaattgctaattgtttaaaaataaatttatctttaaaagatttacaatttgaaactaataacttaccaacgttatctgatttaaaaccaagtggaaaattttttatttcagatttaattaatactggtggaatacaaaaatttttaaaatatttaattgatattaatttaataaatggtaatttattaacggttacaggtaattcattaaaagaaaatttaaaatttattaaaataaattataaaaataaaatactaaaagatatcaataatcctgttaaaaaaactaatcaaatcaaaatattatttggaaacttatcaataaatggttgtatatcaaaaatatcgggtaaagaaggagaaatattctttggaaaagcactagtatttaattcagaagaagaatctgttaattatatttataaaaaaaaaattcaaaataacacaattataattataaggtatgaaggtccaaaaggaggccctggaatgagagaaatgttaactcctacttctgctttaataggagttggaaagaaaaattctgttgctttaataacagatggtagattttcaggtggaagccacggatttgttgtaggacatatttcgccagaagcatatgattttggtacaatttgtttaattaataataatgatctaataataatagatactataaacaattttattagtttatttttaaacaaaagaagcttaaaaagtagattttataaagttaaaatatttaacaaaatagtttcaggtattttaaatttatataaaaaatattcgatttgctcatcgaaaggtgcattattaaattatgaataa

SEQ ID NO: 250 - protein, 549 aa, Candidatus Carsonella
MKSKLITKWPIKAANRAMLRAVGYNDYDFNKFQVGIASTWSNITPCNNHINVLAKAVEYGVNSKFCKGTIFNTITVSDGISNGNFGMKYSLLSRDIISNSIEVVGKAQNFDGIISIGGCDKNIPGCIIGMCNLEIPSIFIYGGTILPGKNRTDIVSVFESLGKFYNKTINEKELLNIEKNSIIGSGSCSGMYTANSMAIVAECLGISLPNSSIQNAQSINKIVNCINSGKLIKILLENNITIKKIINKESILNSIKVISLLGGSTNCLIHLLAIANCLKINLSLKDLQFETNNLPTLSDLKPSGKFFISDLINTGGIQKFLKYLIDINLINGNLLTVTGNSLKENLKFIKINYKNKILKDINNPVKKTNQIKILFGNLSINGCISKISGKEGEIFFGKALVFNSEEESVNYIYKKKIQNNTIIIIRYEGPKGGPGMREMLTPTSALIGVGKKNSVALITDGRFSGGSHGFVVGHISPEAYDFGTICLINNNDLIIIDTINNFISLFLNKRSLKSRFYKVKIFNKIVSGILNLYKKYSICSSKGALLNYE

SEQ ID NO: 251 - DNA, 1674 bp, Synechococcus sp.
atgctccgctccgacgccgtcacgcagggaatctcccgctcccccaaccgcgccatgttgcgtgcggtcggttttggtgacgccgacttcggcaagccgatcatcggcatcgccaacggctacagcaccatcaccccctgcaatgtggggctgaacgatctggcgatgcgagctgaagcgtcagcgcgtcaggccggcggcatgccccaaaccttcggaaccatcaccgtcagcgatggcatttcgatgggcacggaaggaatgaagtactccctggtgagcagggaagtgatcgctgacgcgatcgaaacggcctgcaatggccagagcatggatggggtgctcgctgtcggtggctgcgacaaaaacatgcccggcgccatgctcgcgatggcccgcatgaacatcccgtccatttttgtctatggcggcaccatcaaacccggcaaactcggcggctgtgatctcaccgtggtgagtgcctttgaggccgtaggtcagatcaccagcggcaagattgacgaagaacagctaacggcgattgaaaagaatgcctgccccggtgcaggcagctgtggcggcatgttcaccgccaacaccatgagtgctgcgatcgaaaccctcggtctgagcctgccctacagctccaccatggcggcggaagactccgagaaggctgatagcgcagcccgttcagccgaggtgcttgttgatgccatcaaagccaacattcgcccgcttgatctactcaccaaggaagcgtttgaaaacgccatcagcgtgattatggccgtgggtggctccaccaattcagtgctccacctgctcgccattgcccgcactgccggcgtcgatctgagcatcgacgattttgagcgcatccgtcagcgggtcccggtgatctgtgacctcaaacccagtggccgttttgtcacggttgatcttcatcaggctgggggcattcctcaggtgatgaaattgcttctggatggaggactactccatggcgagtgccgcaccatcgaaggcaaaagcctgaaggaactgttggctgatgtgccttcggttccgcctgctgatcaggaggtcattcgcccactgtccaatcccttgtacgccaaggggcacctggccatcctcaaaggcaacctcgcctcagaaggtgccgtcgcaaagatcagcggtgtgaaaaatccggtgatcaccggtccggcacgggtgttcgaaagcgaagaaacctgccttgccgccatcctcgacaaccaggtcaaggccggtgatgtggtggtcgttcgcaacgaaggcccggtgggtggtcccggcatgcgggaaatgctcagccccacatccgcaattgtgggacagggcctgctcgacaaagtggccctgattaccgacggacgtttctccggtggttcctacggcttggtgatcggccacgtggcgccagaagccgccgtcggtggcaccatcggcctagtgcatgaaggcgacagcatcactgtcgacgccaacaaactgctgattcaactgaacatcgacgaagccgaactggaacgccgccgtaacgcctgggcgcctgcgaccccgaagtaccgcacagggatcctgggcaaatatgcgcgcctggtctcaagttccagccgcggcgccaccaccgacatcgcggactaa

SEQ ID NO: 252 - protein, 557 aa, Synechococcus sp.
MLRSDAVTQGISRSPNRAMLRAVGFGDADFGKPIIGIANGYSTITPCNVGLNDLAMRAEASARQAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETLGLSLPYSSTMAAEDSEKADSAARSAEVLVDAIKANIRPLDLLTKEAFENAISVIMAVGGSTNSVLHLLAIARTAGVDLSIDDFERIRQRVPVICDLKPSGRFVTVDLHQAGGIPQVMKLLLDGGLLHGECRTIEGKSLKELLADVPSVPPADQEVIRPLSNPLYAKGHLAILKGNLASEGAVAKISGVKNPVITGPARVFESEETCLAAILDNQVKAGDVVVVRNEGPVGGPGMREMLSPTSAIVGQGLLDKVALITDGRFSGGSYGLVIGHVAPEAAVGGTIGLVHEGDSITVDANKLLIQLNIDEAELERRRNAWAPATPKYRTGILGKYARLVSSSSRGATTDIAD

SEQ ID NO: 253 - DNA, 1671 bp, Synechococcus sp.
atgctccgctccgatgccgttaccaaggggattcagcgctcacccaatcgggcgatgctgcgagccgtcggtttcggcgatcaggacttcggaaaaccaatcattggcatcgccaacggctacagcacgatcacgccctgcaacgttgggctcgatgatctcgccaggcgtgccgaagaggcggcccgcctagcgggaggtatgcctcaaacgttcgggaccatcaccgtcagcgacgggatctcgatgggaacagagggaatgaaatattccctggtgagccgggaagtgatcgccgacgccatcgaaacagcctgcaatggccagagcatggacggcgtgttggccgtgggcggctgcgacaagaacatgcctggagccatgctcgcgatggcgaggatgaacatcccggcgatcttcgtgtacggcggcaccatcaagcccggaaaactcggcggctgcgacctcaccgtggtcagtgcttttgaagcggtcggtcagatcaccagcggcaagatcgacgaggagcagctcacggccatcgagaaaaatgcctgccccggggctggcagctgcggcggcatgttcaccgccaacaccatgagcgccgccatcgaaacgatgggactcagccttccgcacagctccaccatggctgctgaagatgaagagaaggccgagagcgcagcccgatcggcggaggtgttggtgcaggccatcgaatccggcatccgccccctcgacctgatgacccgtgaggccttcgaaaatgccatcagcgtgatcatggcggtgggtggttccaccaattccgtgctgcatttgctcgccattgcccgcactgctggggtggagctcgccatcgacgactttgaacggatccgccagcgcgttccagtgatctgcgacctcaaacccagtggccgttacgtcacggtggacctccaccgcgccggtggaattccccaggtgatgaaactgctgctggatgccggactcctccacggtgattgccgcaccatcgaaggcaaaaccctgaaggagctgcttgccgatgtgccctccactccgcccgcggatcaggatgtgattcggccgctctccaatcccctttatgccaagggccacctggccatccttaagggcaatctggcttccgaaggagctgtcgcgaagatcagtggtgtgaagaatccggtgatcaccggtccagcaagggtgtttgagagcgaagaaagctgtcttgaagcgattctcgacaatcagatcaaggccggtgatgtggtggtggtgcgcaatgaaggcccggtcggcggaccgggcatgcgcgagatgctcagtcccacgtccgcgatcgtgggacaagggctactcgacaaggtggcgctgatcaccgacggacgcttttcaggtggctcctatggcctcgtgattggccatgtagcccccgaagcggccgtgggcggaaccatcggtttgatcgaggaaggagacagcatcaccgtggacgccaatcagctgctgctgcaactgaatgtggaggaggctgagctggagcggaggcggagtgcatggtcggcaccagtgccgaagtaccgcacggggatcctcggcaaatatgcccggcttgtgagttccagcagccagggtgcggtcaccgaccagccctga

SEQ ID NO: 254 - protein, 556 aa, Synechococcus sp.
MLRSDAVTKGIQRSPNRAMLRAVGFGDQDFGKPIIGIANGYSTITPCNVGLDDLARRAEEAARLAGGMPQTFGTITVSDGISMGTEGMKYSLVSREVIADAIETACNGQSMDGVLAVGGCDKNMPGAMLAMARMNIPAIFVYGGTIKPGKLGGCDLTVVSAFEAVGQITSGKIDEEQLTAIEKNACPGAGSCGGMFTANTMSAAIETMGLSLPHSSTMAAEDEEKAESAARSAEVLVQAIESGIRPLDLMTREAFENAISVIMAVGGSTNSVLHLLAIARTAGVELAIDDFERIRQRVPVICDLKPSGRYVTVDLHRAGGIPQVMKLLLDAGLLHGDCRTIEGKTLKELLADVPSTPPADQDVIRPLSNPLYAKGHLAILKGNLASEGAVAKISGVKNPVITGPARVFESEESCLEAILDNQIKAGDVVVVRNEGPVGGPGMREMLSPTSAIVGQGLLDKVALITDGRFSGGSYGLVIGHVAPEAAVGGTIGLIEEGDSITVDANQLLLQLNVEEAELERRRSAWSAPVPKYRTGILGKYARLVSSSSQGAVTDQP

SEQ ID NO: 255 - DNA, 1674 bp, Synechococcus sp.
atgcttcgctcagacgccgtcactcaaggcattcagcgctcacccaatcgagcaatgctgagagcggttggcttcggtgatgaagatttcggcaagcccattatcgggatcgctaacggttacagcacgattacaccttgcaatgtgggattgaatggtctgtcccgtcgtgccgaagattcggctcgaaaggcaggtggaatgcctcagactttcggaaccatcaccgtcagcgatggcatctcgatgggcacggaaggaatgaaatattccttggtgagccgtgaagtgattgctgatgcaattgaaacggcctgcaatgggcaaagtatggatggcgttctggcggttggtggttgcgataaaaatatgcctggcgccatgttggcgatggcacgtatgaatatcccctcgatttttgtgtacgggggaacaattaagccgggaaaattaggtggctgtgacctcactgttgtgagtgcttttgaggctgtcggtcagattacgagtgggaaaattgatgaagagcagctaactgcgattgaaaaaaatgcctgcccaggtgctggcagctgtggaggcatgttcacggccaatacgatgagtgctgcgattgaaacgatggggctgagtcttccccacagttcaacgatggctgccgaagatgaggaaaaagcagagagtgcggctcgttctggtgaagtcctcgttgaggcaattaaatccaatattcgcccccttgatttgctcacgcgggaagcctttgaaaatgccatcagcgtgatcatggcggtgggcggctccaccaactctgtgttgcatttgcttgctatcgcgcgcacagcaggcgtggatctcagcatcgacgactttgaacagatccgccaacgcgttccggtgatttgtgatctaaaaccgagtggtcgttttgtcaccgtggatcttcatcaggctgggggcattccacaggtgatgaaattgcttttagatgcgggcttgctccatggcgattgccgcacgattgaagggaaaacattgaaagaattgttggctgatattccttcaacgcctcctgaaggacaagaagtgattaggccgttaagtaaccccctttatgccaaagggcatttggccattctgaaaggaaatttggcaagcgaaggagctgtcgccaaaatcagcggcatcaaaacgcctgtcctcacaggtcctgctcgcgtttttgaaagcgaagaggattgtttagcgtcgattattggtaaacatattcatgctggtgatgtcatcgtgattcgccaggaaggtccagtgggaggtcctggaatgcgcgaaatgcttgcaccaactgctgccattgttgggcagggactcggtgacaaggtggcgctgattacggatggtcgattcagtggtggaacctatggtttggtggttggccacgtggctccagaagctgccgttggtggagcaatcggccttgttatggaaggagacagcatcactgtggatgccaatcaaaaccttcttcaactcaatgtgaatgaggctgaactcgaaacacgccgccgcacttggtcaggacataagcctagatacaagactggaattcttggcaaatatgctcgacttgtctcgagttctagtcgtggtgccgtgacagatcagcctgattaa

SEQ ID NO: 256 - protein, 557 aa, Synechococcus sp.
MLRSDAVTQGIQRSPNRAMLRAVGFGDEDFGKPIIGIANGYSTITPCNVGLNGLSRRAEDSARKAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETMGLSLPHSSTMAAEDEEKAESAARSGEVLVEAIKSNIRPLDLLTREAFENAISVIMAVGGSTNSVLHLLAIARTAGVDLSIDDFEQIRQRVPVICDLKPSGRFVTVDLHQAGGIPQVMKLLLDAGLLHGDCRTIEGKTLKELLADIPSTPPEGQEVIRPLSNPLYAKGHLAILKGNLASEGAVAKISGIKTPVLTGPARVFESEEDCLASIIGKHIHAGDVIVIRQEGPVGGPGMREMLAPTAAIVGQGLGDKVALITDGRFSGGTYGLVVGHVAPEAAVGGAIGLVMEGDSITVDANQNLLQLNVNEAELETRRRTWSGHKPRYKTGILGKYARLVSSSSRGAVTDQPD

SEQ ID NO: 257 - DNA, 1674 bp, Synechococcus sp.
atgcttcgctccgacgccgtcaccaaggggatccagcggtctcccaaccgcgccatgttgcgggccgtgggctttggagacagtgatttcggcaagcccatcctgggcattgccaacggctacagcactatcaccccctgcaatatcgggctgaacgacctggccaaacgggctgaggaagcagcccgccaggccggaggcatgccccagatgtttggaaccatcaccgtgagtgatggaatctccatgggcactgaagggatgaagtactccctggtgagccgtgaagtgattgctgacgccatcgaaacggcctgcaacggtcagagcatggatggggtgctggccgttggtggctgcgacaagaacatgcctggcgccatgctggccatggctcggatgaacattccttcggttttcgtctacggcggcacgatcaagccgggcaagctcgggggctgtgatctcacggtggtgagcgcttttgaggcggtggggcaactcaccagcggcaagatcgacgaagtgcagctcaccgcagttgagaaaaatgcctgccctggggctggcagttgcggcggcatgttcaccgccaacaccatgagtgccgccatcgaaacgatggggctgagccttccctacagctccacgatggcagccgaggacgaggaaaaggccgacagtgccgctcgctccgctgaggtgctggtggaggcagtgaaagccaacattcgccctctggacctgctcaccaaggaagcctttgagaacgccattagcgtgatcatggcggtgggtggctccaccaatgcggtactgcacctgctggccattgcccgtaccgccggcgtcgacctgagcatcgatgacttcgaacggatccgtcagcgggtgccggtgatctgtgatctcaagcccagcggccgctacgtgaccgttgatctgcacaacgccggcggcattccccaggtgatgaagctgctgctggatgctggcttgctgcacagcgactgccgaaccgtggaaggcaaaagcctgaaggagttgctggccgatgtgccgtcggagccccccgccgggcaggaggtgatccgccccctcagcaatccgctgtacgccaaaggtcacctcgccatccttaagggcaacctcgccagcgagggaagcgtggccaagatcagcggcgtgaaaacccctgtgctcactggccctgcgcgggtgtttgaaagcgaggaagactgccttgccgccatcctcgataaaaagatccaggccggggatgtggtggtggtccgcaacgagggtcccgttggtggaccgggcatgcgggaaatgctggctccaacttcagcgattgttggtcagggcctgggggacaaggtcgccctgatcaccgatggccgctttagcggcggcacctatggcctggtggtgggtcatgtggctcctgaagctgctgttggtggaacgatcggcctggtgcaagaaggcgacagcatcacggttgatgctgatcagctgctgctccaactcaacgtggatcaagcggaactggatcgccgtcgtgcgggatggagcaagccggaaccgcgttaccgcagcggaattctcggcaagtacgcgcggctcgtctccagctcaagccggggtgcaaccaccgaccacgccgactga

SEQ ID NO: 258 - protein, 557 aa, Synechococcus sp.
MLRSDAVTKGIQRSPNRAMLRAVGFGDSDFGKPILGIANGYSTITPCNIGLNDLAKRAEEAARQAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQLTSGKIDEVQLTAVEKNACPGAGSCGGMFTANTMSAAIETMGLSLPYSSTMAAEDEEKADSAARSAEVLVEAVKANIRPLDLLTKEAFENAISVIMAVGGSTNAVLHLLAIARTAGVDLSIDDFERIRQRVPVICDLKPSGRYVTVDLHNAGGIPQVMKLLLDAGLLHSDCRTVEGKSLKELLADVPSEPPAGQEVIRPLSNPLYAKGHLAILKGNLASEGSVAKISGVKTPVLTGPARVFESEEDCLAAILDKKIQAGDVVVVRNEGPVGGPGMREMLAPTSAIVGQGLGDKVALITDGRFSGGTYGLVVGHVAPEAAVGGTIGLVQEGDSITVDADQLLLQLNVDQAELDRRRAGWSKPEPRYRSGILGKYARLVSSSSRGATTDHAD

SEQ ID NO: 259 - DNA, 1674 bp, Synechococcus sp.
atgcttcgttccgacgccgtcacaaaggggatccagcgttcccccaaccgcgccatgctccgtgcggtgggattcggagatgaggacttcggcaagccgattctcgggatcgccaacggctacagcacgatcacaccctgcaatgtcgggttgaacgacctgtcccggcgcgctgaagaggctgcccgtcaggccggcggcatgccacagatgttcggaaccatcacggtgagtgatggcatctccatgggcaccgaagggatgaagtactccctggtaagccgtgaggtgatcgccgatgcgattgaaaccgcctgcaatggccagagcatggatggcgtgctggcggtgggcggctgcgacaagaacatgcccggcgccatgttggccatggcgcggatgaacattccggctgtgttcgtttacggcggcacgatcaagccggggaaactcggcggctgtgatctcaccgtggtcagcgcctttgaggcagttggtcagctcaccagcggcaacatcgacgaagaccagctcaccgctgtcgaaaagaacgcttgcccaggagccggcagctgcggcggcatgttcaccgccaacacgatgagtgcagccatcgaaacgatggggttgagcctgccctacagctcaacgatggcggcagaagacgaagagaaggccgacaatgccgctcgttcagcagaggtgttgttggacgcggtgaaggccaacattcgacccttggatctgctcaccaacgatgcattcgagaacgccatcagcgtgatcatggcggtgggtggatccaccaacgccgtgctgcacctgctggcgatcgcccgtacggctggggtctccctcagcatcgacgacttcgagcggatccgtcagcgcgtgccggtgatctgtgacctcaagccgagcggccgctacgtgacggtggatctccacaacgctggcggtatcccccaggtgatgagactgctgctcgatgccgggctgctgcatggcgattgccgcaccgttgagggcaaaagcctgcgtgaggtgctggcggatgtgccctccgtgccaccggccgatcaagacgtgatccgtccactgagcaatcccctttacggcaaaggccacctggccatcctcaagggcaacctggccagtgagggcagtgtggccaagatcagcggcgtcaagacaccagtgctcaccggccccgcccgggtatttgagagcgaggaagactgcctcgccgccatcctggatcaacggatcaaggccggcgatgtggtggtggtgcgcaatgaggggcccgtgggaggtccgggcatgcgcgaaatgctggcccctacctccgccatcgtcgggcaaggcctgggagacagggtggctctgatcaccgatggccgcttcagcggcggcacctatggcctggtggtcggtcacgttgcccccgaagccgctgtcggcggaaccatcggcctggtgcagggaggcgacagcatcaccgtggatgccgaccagttgctgctgcaactcaacgtggatgaggcggaactcacgcgacgccgggcagcctggagcaagccggaaccccgttatcgcactgggattctgggcaagtacgcccgtctggtgtccagttcaagccgtggagcggtcaccgaccagcccgactga

SEQ ID NO: 260 - protein, 557 aa, Synechococcus sp.
MLRSDAVTKGIQRSPNRAMLRAVGFGDEDFGKPILGIANGYSTITPCNVGLNDLSRRAEEAARQAGGMPQMFGTITVSDGISMGTEGMKYSLVSREVIADAIETACNGQSMDGVLAVGGCDKNMPGAMLAMARMNIPAVFVYGGTIKPGKLGGCDLTVVSAFEAVGQLTSGNIDEDQLTAVEKNACPGAGSCGGMFTANTMSAAIETMGLSLPYSSTMAAEDEEKADNAARSAEVLLDAVKANIRPLDLLTNDAFENAISVIMAVGGSTNAVLHLLAIARTAGVSLSIDDFERIRQRVPVICDLKPSGRYVTVDLHNAGGIPQVMRLLLDAGLLHGDCRTVEGKSLREVLADVPSVPPADQDVIRPLSNPLYGKGHLAILKGNLASEGSVAKISGVKTPVLTGPARVFESEEDCLAAILDQRIKAGDVVVVRNEGPVGGPGMREMLAPTSAIVGQGLGDRVALITDGRFSGGTYGLVVGHVAPEAAVGGTIGLVQGGDSITVDADQLLLQLNVDEAELTRRRAAWSKPEPRYRTGILGKYARLVSSSSRGAVTDQPD

SEQ ID NO: 261 - DNA, 1674 bp, Synechococcus sp.
atgctcagatccgacgccgttaccaaagggattcagcgatcccccaaccgcgccatgctccgggccgttggttttggtgatgctgatttcggcaaaccgatcctgggaatcgccaacggctacagcacgattacgccctgcaatatcgggcttgatgttttagcgaaacgtgccgaagaagcggcccgtctggctggaggaatgccgcaaatgtttggcaccatcacggtgagtgatggaatctcgatggggactgaagggatgaaatattcccttgtcagccgagaagtcatcgccgatgccatcgaaacggcctgtaacggtcagagcatggatggagtcttggcagttggtggctgcgacaaaaatatgcctggtgcgatgttggccatggcacggatgaatatcccctccgtgtttgtttatgggggaacgatcaagccgggaaaactcggcggctgtgatctcactgtggtgagtgcctttgaagccgttggtcaaatcaccagcggcaaaatcgatgaagaacaactcacggcggtggaaaagaacgcctgtcctggtgcaggaagttgcggcggcatgtttaccgccaacacgatgagtgcagccatcgaaacgatggggttaagccttccttacagctccacgatggcggccgaagaccaggaaaaagcggacagcgcggctcgctcagcagaggtgttggtggatgccgtgaaagccaacatccggccgctcgatctgctcacaaaacaagccttcgaaaacgccatcagcgtgatcatggcggtcggcggttccaccaatgccgttttgcatttgctggcgattgctcgcacagctggggttgatttgagcattgacgactttgaacgcattcggcaacgcgtcccagtgatctgcgatctcaaacccagcggtcggtttgtcaccgttgatctgcacaacgctggaggaatccctcaagtgatgaagttgctgcttgatgccggattgctccacggcgattgccaaacagttgaagggaaaagtctcaacgcattgttggcggatgtgccatctgcaccccccgcagaccaagaggtgattcgacctctgagcaatccgatgtacagcaaaggacaccttgccatcctcaaaggaaatttggccctggagggcagtgtggccaagatcagcggcgtcaaaactcctgtactgacgggtccagctcgggtttttgaaagtgaggaagactgtctggcctccatccttgagaaaaggatcaatgcgggagacgtcgttgtgatccgctacgaaggtccggtcggtggacctggcatgcgggaaatgttggcgcccacctcagccatcgtcggccagggactcggcgacaaagtggcattaattaccgatggacgatttagcggtggtacctacggactcgtggtgggtcacgtcgctccagaagccgctgttggtggaacgattggccttgtgcaagagggagacagcatcaccgtggatgccaatcaactcttgcttcagctcaatgttgacgacacggaattagccaaacgacgagcagcatggtcgaaaccaaaacctcaatacaccactggaattttgggtaaatatgcccgactcgtttccacatccagcaaaggggctgtcaccgatcaaccggattaa

SEQ ID NO: 262 - protein, 557 aa, Synechococcus sp.
MLRSDAVTKGIQRSPNRAMLRAVGFGDADFGKPILGIANGYSTITPCNIGLDVLAKRAEEAARLAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQITSGKIDEEQLTAVEKNACPGAGSCGGMFTANTMSAAIETMGLSLPYSSTMAAEDQEKADSAARSAEVLVDAVKANIRPLDLLTKQAFENAISVIMAVGGSTNAVLHLLAIARTAGVDLSIDDFERIRQRVPVICDLKPSGRFVTVDLHNAGGIPQVMKLLLDAGLLHGDCQTVEGKSLNALLADVPSAPPADQEVIRPLSNPMYSKGHLAILKGNLALEGSVAKISGVKTPVLTGPARVFESEEDCLASILEKRINAGDVVVIRYEGPVGGPGMREMLAPTSAIVGQGLGDKVALITDGRFSGGTYGLVVGHVAPEAAVGGTIGLVQEGDSITVDANQLLLQLNVDDTELAKRRAAWSKPKPQYTTGILGKYARLVSTSSKGAVTDQPD

SEQ ID NO: 263 - DNA, 1677 bp, Synechococcus sp.
atggcccccctccgatccagcgccatcacgcaaggtgttcagcgcagtcccaaccgcgccatgttgcgcgctgttggtttcggagatggtgacttcagcaaaccgatcatcgggattgccaacggttacagcaccatcacgccctgcaatgtggggctcaacgatctagccctgcgcgccgaagcagccacacaagcagccggggggatgccgcaactcttcggcaccatcaccgtgagtgatggcatctccatgggcaccgaggggatgaagtactccctggtgagccgcgaagtgattgccgatgccatcgagaccgcctgcaacggtcaaagcatggatggcgtattggccatcggcggctgcgacaaaaacatgcccgccgccatgttggcgatggcgcggatgaacatcccaggtgtcttcgtctatggcggcaccatcaagcccggcaaattgggcggctgcgacctcaccgtggtcagcgcctttgaagcggttggtcagttgagcagcggcaagatcgatgaagcccagctcaccgctgttgaaaagaacgcttgcccaggagctggcagctgtggtggcatgttcacggccaacacgatgagtgcggccatcgaaacgatggggttgagcttgccgttcagctccaccatggcggcggaagatcccgagaaagccgagagcgctgctcgctcggctgaggtgttggtggaggccattgctgccaacattcgtccgttggatctgctgacccgcgaagcgtttgaaaacgccatcagcgtgatcatggccgtgggtggctccaccaatgcggtgttgcacttgctcgcgattgcacgcaccgccggcgtaccactgtcaatcgacgacttcgaaacgattcggcaacgggtgcctgtgatctgcgatctcaaaccaagcggacgctttgtaacggtcgacctgcacaacgctggtggcattccgcaagtcatgaaacttctgctcgatggtgggttgctccatggcgattgccgcaccgtggagggcaaaaccttgcgagaggttctggctgatgttccctcagaaccgccggctgatcaggaggtgatccggcccctgagcaatcccctctatgccaaagggcacctggctgtgttgaaaggcaacctcgccagtgaaggggctgtcgccaagatcagtggtgtcaaaacaccagtgctcacaggcccagccagggtgtttgaaagcgaagagcagtgcctgcaggcgatcttggcgaaccaggttcacgcaggtgatgtggtggtggtgcgcaatgaaggccccgttggtggcccgggaatgcgggagatgttggcgcccaccgccgccatcgttggtgaagggctcggcgacaaggtggcgttgatcaccgacggtcgcttcagcggcggcacctacggcctggtggttgggcatgtggccccagaagcagccgtaggcggcatgatcggcctggtgcaagagggcgattccatcaccgtggatgcccaacaacaattgctgcagctcaatgtggatgccgctgaattggagcggcgcaagcaagcgtgggtcaaaccagaaccgcgttaccgcaccggtgttttgggtaaatacgcccgtttggtgagcagcagcagcaagggcgctgtgactgatcaaccctga

SEQ ID NO: 264 - protein, 558 aa, Synechococcus sp.
MAPLRSSAITQGVQRSPNRAMLRAVGFGDGDFSKPIIGIANGYSTITPCNVGLNDLALRAEAATQAAGGMPQLFGTITVSDGISMGTEGMKYSLVSREVIADAIETACNGQSMDGVLAIGGCDKNMPAAMLAMARMNIPGVFVYGGTIKPGKLGGCDLTVVSAFEAVGQLSSGKIDEAQLTAVEKNACPGAGSCGGMFTANTMSAAIETMGLSLPFSSTMAAEDPEKAESAARSAEVLVEAIAANIRPLDLLTREAFENAISVIMAVGGSTNAVLHLLAIARTAGVPLSIDDFETIRQRVPVICDLKPSGRFVTVDLHNAGGIPQVMKLLLDGGLLHGDCRTVEGKTLREVLADVPSEPPADQEVIRPLSNPLYAKGHLAVLKGNLASEGAVAKISGVKTPVLTGPARVFESEEQCLQAILANQVHAGDVVVVRNEGPVGGPGMREMLAPTAAIVGEGLGDKVALITDGRFSGGTYGLVVGHVAPEAAVGGMIGLVQEGDSITVDAQQQLLQLNVDAAELERRKQAWVKPEPRYRTGVLGKYARLVSSSSKGAVTDQP

SEQ ID NO: 265 - DNA, 1671 bp, Synechococcus sp.
atgctccgctccgccgcgatcacccaggggattcagcgctctccgaatcgagccatgctccgtgctgtgggtttcggcgacggcgacttcaacaagccgatcatcggcatcgccaacggctacagcaccatcaccccctgcaatctggggctcaatgatcttgctcgacgcgccgaggaagccgcccatcaggtgggagcgatgccccagatgttcggcaccatcaccgtgagcgatgggatttcgatggggaccgaagggatgaaatattcccttgtgagccgggaggtgattgccgattcgatcgaaacggtcgtcaacgggcaaagcatggatgccctgctggcgatcggtggctgtgacaagaacatgcctggtgccatgctggcgatggcgaggatgaacgtcccctcgatcttcgtgtatggcggcaccatcaagcctggcaagctcggtgcctgtgacctcaccgtggtgagtgcctttgaggcggtgggccagttcagtggcggcaagatcgaggagcaggaactcacggcgatcgagaaaaacgcctgccctggggcgggcagctgcgggggcatgtttactgccaacaccatgagtgccgccttcgaggtgctggggctgagcttgccctacagctccacgatggcggccgaagaccccgagaaggccgatagcgccgcccgtagtgccgaggttttggccgacgccatcgaggcccagatcctcccgcgcgatctgatgacgcgcgaagccttcgaaaacgccatcagtgtgatcatggccgtgggtggctccaccaactccgtgctgcatctgctggctgtcgcccgcacggcgggggtggcgctgagcattgacgacttcgagcggatccggcagcgcgtgccggtgatctgtgatctcaagccaagtggccgcttcgtgacggtggatctgcaccgggctgggggcattccccaggtgatgaaactactgctcgatgcagggctcttgcacggcgactgccgcacgatcgaaggcaagacccttcacgaggtgctcgccgctgtgccgtcggtcccccccgccggccaggaggtgattcggcccctgagccatccgctgtatgccaaggggcacctggcgatcctcaaaggcaacctggccgaggaaggcgcggtggccaagatcagcggcgtcaaaaacccggtcatcaccggccctgcccgcgtgttcgagagcgaagaaacctgcctggccgccattctcgacaagcagatcaaccccggcgatgtggtggtcgtgcgcaatgaggggccggtgggcggtcctggcatgcgggagatgctcagccccacctccgcgatcgtgggccaggggctgctcgacaaggtggctctgatcaccgatggccgcttctcaggcggttcctacggcctggtgatcggccacgtggctccggaggccgccgtggggggcacaatcggcctggtgcaggaaggcgacagcatcaccgtggatgcgaatcagctgctgattcaactcaacgtggatgaatccgagctagctcaacgtcgcgccgcctggacccaacccgaaccccggtatcgcaccggcatcctcggcaaatacgcccgacaggtgagctccagcagtgtgggggcggtgaccgatcagccctga

SEQ ID NO: 266 - protein, 556 aa, Synechococcus sp.
MLRSAAITQGIQRSPNRAMLRAVGFGDGDFNKPIIGIANGYSTITPCNLGLNDLARRAEEAAHQVGAMPQMFGTITVSDGISMGTEGMKYSLVSREVIADSIETVVNGQSMDALLAIGGCDKNMPGAMLAMARMNVPSIFVYGGTIKPGKLGACDLTVVSAFEAVGQFSGGKIEEQELTAIEKNACPGAGSCGGMFTANTMSAAFEVLGLSLPYSSTMAAEDPEKADSAARSAEVLADAIEAQILPRDLMTREAFENAISVIMAVGGSTNSVLHLLAVARTAGVALSIDDFERIRQRVPVICDLKPSGRFVTVDLHRAGGIPQVMKLLLDAGLLHGDCRTIEGKTLHEVLAAVPSVPPAGQEVIRPLSHPLYAKGHLAILKGNLAEEGAVAKISGVKNPVITGPARVFESEETCLAAILDKQINPGDVVVVRNEGPVGGPGMREMLSPTSAIVGQGLLDKVALITDGRFSGGSYGLVIGHVAPEAAVGGTIGLVQEGDSITVDANQLLIQLNVDESELAQRRAAWTQPEPRYRTGILGKYARQVSSSSVGAVTDQP

SEQ ID NO: 267 - DNA, 1617 bp, Synechococcus sp.
atgttgcgggccgtgggcttcggcgacggtgacttcaacaagccgatcatcggcatcgccaatggctacagcacgatcacgccctgcaacatcggcctgaacgatctggcccgctgcgccgaggagtctgcccgtctggctggggccatgccacagatgttcggcacgatcaccgtcagcgacgggatctcgatgggcaccgaggggatgaagtattccctggtgagccgggaggtgatcgctgattcgatcgaaaccgcctgcaacgcccagagcatggatggcctgctggccatcggcggctgcgataagaacatgcccggcgccatgctggcgatggcgcgcatgaacatcccggcgatcttcgtgtacggcggcacgatcaaacccggccggctcggcccctgcgacctcaccgtggtgagtgccttcgaggctgttggtcagttctcgggcggtcgcatcgatgaggaggaactgctggcgatcgagaagaacgcctgccccggcgccggcagctgcggcggcatgttcaccgccaacacgatgagttcggcgttcgaagcgatgggcctgagcctgccgggcagctccaccatgacggccgaggatccggagaaggccgagagcgctgcccgctccgccgaggtgctggtgcgggccatcgaggcgaacatccgcccccgtgatctgatcacccgcgaggcgatcgagaacgccatcagcgtgatcatggcggtgggggggtccaccaattcggtgctgcacctgctggcgatcgcccgcaccgccgaggtgccgctcacgatcgacgatttcgagacgatccgtcagcgggtgccggtgatctgcgatctcaagcccagcggccgtttcgtgacggtggatctgcaccgggccggcggcattccccaggtgatgaagctgctgctggatgccggcctgctgcacggcgattgccgcaccatcgaaggcctcacgctcaagcaggtgctggcggaggtgcccagcgagccccccgccgatcaggacgtgatccggcccctctccaatccgctctatgccaagggtcacctggcgatcctcaagggcaacctggccgaggaaggggccgtcgccaagatcagtggcgtcaagaccccggtgatcacggggccggcccgggtgttcgagagtgaggagagcgccctggaggcgatcctcgccggtgaggtccatgccggtgatgtggtggtggtgcgctacgagggcccggtgggcgggcccggcatgcgtgagatgctctcgcccacggccgcgatcgtgggccagggcctgggggaatcggtggcgctgatcaccgacggtcgcttcagcgggggctcctacggcctggtggtgggccatgtggcccccgaggccgccgtgggcggcaccatcgccctggtgcaggagggcgacagcatcaccgttgatgcccatcagctgctcatccagctcaatgtggaaaccagcgagctggagcggcgccgggcggcctgggtcaggcccgaaccgcgctaccgcactggagtgctgggcaagtacgcccggctggtgagcagcagcagcctgggggcggtcaccgatcagggttga

SEQ ID NO: 268 - protein, 538 aa, Synechococcus sp.
MLRAVGFGDGDFNKPIIGIANGYSTITPCNIGLNDLARCAEESARLAGAMPQMFGTITVSDGISMGTEGMKYSLVSREVIADSIETACNAQSMDGLLAIGGCDKNMPGAMLAMARMNIPAIFVYGGTIKPGRLGPCDLTVVSAFEAVGQFSGGRIDEEELLAIEKNACPGAGSCGGMFTANTMSSAFEAMGLSLPGSSTMTAEDPEKAESAARSAEVLVRAIEANIRPRDLITREAIENAISVIMAVGGSTNSVLHLLAIARTAEVPLTIDDFETIRQRVPVICDLKPSGRFVTVDLHRAGGIPQVMKLLLDAGLLHGDCRTIEGLTLKQVLAEVPSEPPADQDVIRPLSNPLYAKGHLAILKGNLAEEGAVAKISGVKTPVITGPARVFESEESALEAILAGEVHAGDVVVVRYEGPVGGPGMREMLSPTAAIVGQGLGESVALITDGRFSGGSYGLVVGHVAPEAAVGGTIALVQEGDSITVDAHQLLIQLNVETSELERRRAAWVRPEPRYRTGVLGKYARLVSSSSLGAVTDQG

SEQ ID NO: 269 - DNA, 1671 bp, Prochlorococcus marinus
atgctcagatccgccgccatcacaaagggaactcaacgctctcccaaccgagccatgcttcgcgcagtgggctttggcgacgaagacttcaataaaccaatcatcggtatagccaacggctacagcacgatcactccttgcaacatcggtcttaatgacctggcgcgacgttcagaagaagcagcccgccaggccggtgcaatgccccagatgttcggcaccatcactgtcagtgatggcatctctatgggcaccgaagggatgaaatattccctggtaagtcgcgaggtgattgctgattcgatcgagacagcctgcaacgcccaaagcatggacggcgtactagcaatcggtggctgtgacaaaaacatgcctggagcgatgatcgccctggcccgaatgaacatcccaggtgtctttgtctatggcggaacgatcaaaccaggaaaattggctgaccgcgacctcactgtagtcagcgcctttgaagctgttggtcagcatgccagtggcaagataaatgaggagcaactcaccgctatcgagaagaacgcttgcccaggagcaggaagttgcggtggcatgtttacagccaacacgatgtcagccgctattgaaacattgggattgagtttgccttacagctcaacgatggctgcagaggatgaggaaaaagcaaatagcgcagcccgtagtgctgaagtgcttgtggatgccattaaggcaaatatctgtccccgcgatctactcaccaagaacgcatttgaaaacgcgattagcgttgtcatggcagtgggcggctccaccaatgcagttctgcatctgcttgcgattgcccgtagcgcaggcgtagacctttgcatcgatgacttcgagcgcatccgccagcgtgtaccggtgatttgtgatctaaaacccagcggccgttacgtgactgttgatttgcataacgcaggcggcattccccaagtgatgaaacagttgcttgatgcaggcttacttcatggagactgccgcaatgtggaaggtaaaaccttgagagaactgctcaaggatgtgccatccgagccttcagcagagcaagacgtcattcatcccctctcgaaaccggtctatgccaaggggcacctggcgatccttaaaggcaatctggccagcgaaggatgcgtggccaagataagcgggatcaaaaccccagtacttactggacctgcaagggtttttgaaagcgaggaggcctgccttgctgccattctcaacaacaaggtgaaggcgggagatgtcgtcgtcatacgtaacgaaggcccggttggcgggcctggaatgcgagagatgcttgctcctacatctgccatcgtcggtgaagaccttggcgacaaggtggccttaatcacagatggacgcttcagcggaggtacctatggtttggtggtgggccatgtggcaccggaagcagccgtaggcggcatgattggccttgtgcaggaaggcgacagcatcaccatcgatgccaatcaactgctgatccaactcaatgtcgagaaggatgaattggagcgtcgctccagcgcatgggaaaaaacacagccgcgttatcaaacaggagttctcggtaaatacgcccgaatggtgagtagcgccagcaatggtgctgtcaccgaccagccctga

SEQ ID NO: 270 - protein, 556 aa, Prochlorococcus marinus
MLRSAAITKGTQRSPNRAMLRAVGFGDEDFNKPIIGIANGYSTITPCNIGLNDLARRSEEAARQAGAMPQMFGTITVSDGISMGTEGMKYSLVSREVIADSIETACNAQSMDGVLAIGGCDKNMPGAMIALARMNIPGVFVYGGTIKPGKLADRDLTVVSAFEAVGQHASGKINEEQLTAIEKNACPGAGSCGGMFTANTMSAAIETLGLSLPYSSTMAAEDEEKANSAARSAEVLVDAIKANICPRDLLTKNAFENAISVVMAVGGSTNAVLHLLAIARSAGVDLCIDDFERIRQRVPVICDLKPSGRYVTVDLHNAGGIPQVMKQLLDAGLLHGDCRNVEGKTLRELLKDVPSEPSAEQDVIHPLSKPVYAKGHLAILKGNLASEGCVAKISGIKTPVLTGPARVFESEEACLAAILNNKVKAGDVVVIRNEGPVGGPGMREMLAPTSAIVGEDLGDKVALITDGRFSGGTYGLVVGHVAPEAAVGGMIGLVQEGDSITIDANQLLIQLNVEKDELERRSSAWEKTQPRYQTGVLGKYARMVSSASNGAVTDQP

SEQ ID NO: 271 - DNA, 1671 bp, Prochlorococcus marinus
atgcttagatcaaatgcaataacacagggtattcaacgatcaccaaaccgagcaatgcttagagctgttgggtttgatgataatgattttaacaagccaatcattggaatagctaatgggcacagcacaataaccccatgcaatatgggattaatggatttagctaatagagcagagtcagcgttaaaagaggctggtgcaatgcctcaaactttcggaaccataactgttagtgacggcatttccatgggaacggaagggatgaaatactcattagtttcaagagaagttattgcagattcaatcgagacggcttgcaatgctcaaagcatggatggggtgttagcgataggtggatgcgataaaaatatgccaggagcaatgttatcaatggcaagaatgaacataccttcgatttttgtttatggggggacaattaaacctgggaaattagacggttgcgacttgaccgtggtgagttcatttgaggctgtcggtcaattagcaagcggaaaaatcgacaaagatcgtttaatagctgtagaaaaaaatgctatccctggaccaggcagttgcggagggatgtttactgctaataccatgtctgcggcaatagaaacgatgggttttagtttgccatttagttcaacaatggctgcagtagatgatgaaaaagcagaaagcgctgctgaaagtgctcaggtccttgtaaatgcagtaaagaataacatcaggccattagatttacttacgaaagaagcctttgagaatgcaatcagtgtcatcatggctgtaggcggctcaacaaattctgtccttcacctacttgctatagctaggactgcaggagttgatttaacgatcgatgactttgaacgtataaggcagactgttcctgtgatttgcgacctcaaaccaagcggtaaatacgtaacagtcgacctacataaagctggtgggattcctcaagtaatgaaattactcctcgatgcaggaatgctacatggagaatgcaaaaccattgaaggaaaaacaattaaagaagttcttagagatatcccctcaaagcccaaagaaaatcaagacgttataagacaaatatcaaaccctatttataaaaaaggacatcttgctattctcaaaggaaatttagcaagtgaaggaagtgtcgcaaaaattagtggtgtaaagactcccgttttaaccgggcctgcaagggtctttgagagtgaagaagaatgcttaactgccattcttgacaataaagtaaaagctggagatgtagtcgtcgttaggtatgaaggacctgtaggagggcctgggatgagggagatgctctctccaacctcagcgattgtaggtcaaggtttaggagagaaagttgcactaattactgatggtcgatttagtggaggatcatatggattagtggttggccacgttgctccagaagcagccgtcggaggaacaattggattagtagaggaaggagacagtattaccgttgacgctaataaattgttaattcaattaaatgtcgaagagcgagaactagctagaagaaaacagaaatgggagaagccaaagcctagatataagacaggcattcttgggaagtattccagattagtaagttcatcaagccaaggagcgacaactgatcaaatataa

SEQ ID NO: 272 - protein, 556 aa, Prochlorococcus marinus
MLRSNAITQGIQRSPNRAMLRAVGFDDNDFNKPIIGIANGHSTITPCNMGLMDLANRAESALKEAGAMPQTFGTITVSDGISMGTEGMKYSLVSREVIADSIETACNAQSMDGVLAIGGCDKNMPGAMLSMARMNIPSIFVYGGTIKPGKLDGCDLTVVSSFEAVGQLASGKIDKDRLIAVEKNAIPGPGSCGGMFTANTMSAAIETMGFSLPFSSTMAAVDDEKAESAAESAQVLVNAVKNNIRPLDLLTKEAFENAISVIMAVGGSTNSVLHLLAIARTAGVDLTIDDFERIRQTVPVICDLKPSGKYVTVDLHKAGGIPQVMKLLLDAGMLHGECKTIEGKTIKEVLRDIPSKPKENQDVIRQISNPIYKKGHLAILKGNLASEGSVAKISGVKTPVLTGPARVFESEEECLTAILDNKVKAGDVVVVRYEGPVGGPGMREMLSPTSAIVGQGLGEKVALITDGRFSGGSYGLVVGHVAPEAAVGGTIGLVEEGDSITVDANKLLIQLNVEERELARRKQKWEKPKPRYKTGILGKYSRLVSSSSQGATTDQI

SEQ ID NO: 273 - DNA, 1674 bp, Prochlorococcus marinus
atgaataaacttagatcatctgctattacccaaggtgtgcaaaggtcacctaacagatcaatgttaagggcagttggttttaatgatgaagattttaacaaacctattattggggttgccaatggttacagcacaataaccccatgcaatatagggttaaataaattagctctcaaagctgaagagtcaattagacgatcagggggaatgcctcaaaaattcgggaccatcactgtaagtgatggcatttccatgggaacagaggggatgaaatattcattagtttcaagagaagtaatagctgactcgattgaaacagcatgtaatgctcaaagtatggatgcagtacttgctataggtggatgcgataaaaatatgcctggagcaatgatagcgattgcgaggatgaatattccctcaatatttatctatggaggaactataaaaccaggcaaattacatggggaagatcttacggttgttagtgcgttcgaagctgttggacagttaacatcaggcaaaattaatgagaaaaggttaatcgaagttgagaaaaattgtatccctggagctggaagctgtgggggaatgtttacggctaatacaatgtctgcagtaatagaagtgttaggtttaagccttccacacagttcaactatggctgctgaagatcttgaaaaagaactaagtgcagaaaaaagtgctgagatattagtatctgcgattaaaaaaaatataagaccattagacttaatgactaaaaaagcatttgaaaatgcaatatcagtaattatggccgtaggaggttcaacgaatgcagtattacatatattagcaatagcaaatactgcaggtattgatattaatattgatgactttgagaggataagacaaaaagttcctgtaatttgtgaccttaagccaagtggaaaatttgtaacagttgatcttcataatgcagggggaattccccaagttatgaaaatactcctaaatgcaggattaattcatggggaatgcaaaaacattgaaggcaaaactataactgaatacttacaaaacattccagataagcctcctagtaatcaaaatgtcatccgaggaatagattatcccctttataaaaaagggcatttagcaattttaaaagggaacctggcaaaggaaggttctgtagcaaaaattagtggagtaaaaaatccagttttaacaggtccagcaaagatattcgagagtgaagaagattgtcttaaagcaatcttaaataacgaaattatagctggtgatgttgttgttgtaagaaatgaaggtcctgtcggaggtccagggatgagagaaatgttatccccaacatcagcaattgttggacaaggacttggagaaaaagtggccttaattactgatggtaggtttagcggtggctcttatggtcttgttgtcgggcatatagcccctgaagcagctgtcggtggaaacattgctctaataaaagaaggtgatttgattacagttgatgctgtaaagcaactaattgaggttgatttatctgacgaagaattagaaaaaagaaaaaataattgggtaaaacctaaacctaaatataaaagaggaatactttcaaagtattcgaaaatagtaagtacatcaagtttaggggctgttactgatttatag

SEQ ID NO: 274 - protein, 557 aa, Prochlorococcus marinus
MNKLRSSAITQGVQRSPNRSMLRAVGFNDEDFNKPIIGVANGYSTITPCNIGLNKLALKAEESIRRSGGMPQKFGTITVSDGISMGTEGMKYSLVSREVIADSIETACNAQSMDAVLAIGGCDKNMPGAMIAIARMNIPSIFIYGGTIKPGKLHGEDLTVVSAFEAVGQLTSGKINEKRLIEVEKNCIPGAGSCGGMFTANTMSAVIEVLGLSLPHSSTMAAEDLEKELSAEKSAEILVSAIKKNIRPLDLMTKKAFENAISVIMAVGGSTNAVLHILAIANTAGIDINIDDFERIRQKVPVICDLKPSGKFVTVDLHNAGGIPQVMKILLNAGLIHGECKNIEGKTITEYLQNIPDKPPSNQNVIRGIDYPLYKKGHLAILKGNLAKEGSVAKISGVKNPVLTGPAKIFESEEDCLKAILNNEIIAGDVVVVRNEGPVGGPGMREMLSPTSAIVGQGLGEKVALITDGRFSGGSYGLVVGHIAPEAAVGGNIALIKEGDLITVDAVKQLIEVDLSDEELEKRKNNWVKPKPKYKRGILSKYSKIVSTSSLGAVTDL

SEQ ID NO: 275 - DNA, 1674 bp, Prochlorococcus marinus
atgaataaactcagatcatctgcaataacccaaggtgtgcaaagatcacctaacagatcgatgttaagagctgttggatttaatgatgaagattttaataaacctattattggagttgcaaatggatacagcaccataacaccatgcaatatgggtttaaataagttagctctaaaagctgaagagtctataaaaagatcaggtgggatgcctcagatgtttgggactataacagtaagtgatgggatttctatgggaacagagggcatgaaatattccctagtttcaagagaagttattgctgattcaattgaaacagcatgcaatgctcagagtatggatggagtacttgctataggtggatgtgataaaaatatgccgggtgccatgattgcgattgcaagaatgaatattccatcaattttcatttatggaggaacaataaagcctgggaaattgcatggagaagatcttactgttgttagtgcatttgaagctgttggacaattaacatcaggcaaaattaatgaagaaaggctaatccaagttgagaaaaattgtattcctggtgctggtagctgtggaggaatgtttacagctaatacaatgtctgcggttattgaagtattagggttaagtcttcctcacagttccactatggctgctgaagatcttgaaaaagaactaagtgcagacaaaagtgctgagatattagtctccgcaatagaaaaagatataagacctctagacctaatgactaagaaagcatttgaaaatgcaatatcagtaattatggcaattggcggatcaacaaatgcggtattgcacatcttagctatcgcgaatactgcaggaatagatatcaacattaatgattttgagagaatcagacaaaaagtacccgttatttgtgaccttaaaccgagtggtaaatatgtgacggtggatcttcataaggcaggtgggattccacaagtaatgaaaatacttttgaatgcaggattaattcatggcgattgcaaaaacattgaaggaaaaaccatctcagaatacttacaaaatattccagataagcctccaacaaatcaaaatgtcataagagacatagataaccctctttataaaaaaggacatctagcgatattaaaaggtaacttagcgagcgaaggttctgtagccaaaattagcggagtaaaaaaccctgtattaacaggtcccgcaaaaatttttgaaagtgaagaagattgtttaaaatcgatattaaataacgatatcaaagctggtgatgttgttgttattagaaacgaaggtcctgtaggaggaccaggtatgagagagatgttagctccaacatctgcaattgttggtcaagggctaggagagaaggtggctttaattaccgatggcagatttagcggcggtacctatggtcttgttgtgggtcacatagctccagaggctgctgtaggaggaaatattgctctaataaaacaaggtgatttaattacagtagatgctgtaaaacaactaattgaagttgatttatctgacgaagaattagaaaaaagaaaaaaagattgggtaaaacctattcaaaaatacaaaagaggaattctttcaaaatattcgagaatcgtaagcacatcaagtttaggggctgttactgatttataa

SEQ ID NO: 276 - protein, 557 aa, Prochlorococcus marinus
MNKLRSSAITQGVQRSPNRSMLRAVGFNDEDFNKPIIGVANGYSTITPCNMGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIRPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDIDNPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAVKQLIEVDLSDEELEKRKKDWVKPIQKYKRGILSKYSRIVSTSSLGAVTDL

SEQ ID NO: 277 - DNA, 1680 bp, Prochlorococcus marinus
atgaataaattaagatcttctgcaataactcaaggtgttcaaagatctcctaacagatcaatgttaagagcagttggatttagtgatgatgatttcactaaaccaatcattggagtcgctaatggatatagcaccattacaccctgcaatatgggccttaacaagttagctcttaaggcagaagattcaataaggaaatcaggaggaatgcctcaaatgttcggaactatcaccgtaagcgatgggatctccatgggaacagaaggaatgaaatattctttagtttcaagggaagtaatagccgattcaatagaaactgcctgtaatgcgcaaagtatggatggtgttttagctattggtggttgtgataaaaatatgccgggtgcaatgatagcaattgcaagaatgaatatcccttccatatttatttatggaggaacaataaaacctggaaagttaaacggtgaagacttaacggttgtcagtgcatttgaagctgttgggcaattaacctcgggtaaaataaatgagaagagattaaatgaagttgagaaaaattgtattccaggagcaggaagttgtggaggaatgttcacagctaatactatgtcagcagttatagaagtcttaggtttaagtcttcctcatagttcaacaatggcagccgaagattatgagaaggtggtaagtgctgaaaaaagcgctgaaatacttgtagatgcaataaaaaaagatataaggccactagatcttatgactaaagaatcttttgaaaatgcaatatctgtaattatggctattggaggttcgacaaatgcagtgcttcacatattagcgatagcgaatactgcaggtatagagatcaatattgatgattttgaaagaataagacaaaaagttcctgtgatttgtgatttgaaacctagcggcagatatgtcacagtagatcttcataatgcaggaggcattccacaagtaatgaaaatacttttaaatgcaggattaataaatggtgattgcaaaaatatcgaaggtaaaacaatatctgaatatttacttaatattccagataatcctcctgaaaatcaaaatgttattagaaacataaataatcctctttataaaaaaggtcatttagcaatattaaaaggtaatttagcttcggaaggttgtgtagcaaaaatcagcggagtaaagaatccagttttaaagggtcccgctcgaatttttgaaagtgaggaagattgtcttaaatcaattttgaataatgatattaaagctggtaatgttgtcgttataagaaatgaaggtcctgtgggaggaccgggaatgagagaaatgttagctccaacatctgcaattgttgggcaagggctgggagaaaaagtagctttaataactgatggtagatttagtggaggtacctatggccttgttgttggacatatcgcaccagaggcagcagtaggagggaatatagctttaataagagagggagatttaatcactgttgatgctgtaaaccaattaattgaagttgaactatctgatggggaattagaaaaaagacgaattaactggataaagcctattccgaaatataagaaaggtgtactttcaaaatattcaagaattgtaagtacttcaagcttaggtgcagttacagatctggaaaaataa

SEQ ID NO: 278 - protein, 559 aa, Prochlorococcus marinus
MNKLRSSAITQGVQRSPNRSMLRAVGFSDDDFTKPIIGVANGYSTITPCNMGLNKLALKAEDSIRKSGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLNEVEKNCIPGAGSCGGMFTANTMSAVIEVLGLSLPHSSTMAAEDYEKVVSAEKSAEILVDAIKKDIRPLDLMTKESFENAISVIMAIGGSTNAVLHILAIANTAGIEINIDDFERIRQKVPVICDLKPSGRYVTVDLHNAGGIPQVMKILLNAGLINGDCKNIEGKTISEYLLNIPDNPPENQNVIRNINNPLYKKGHLAILKGNLASEGCVAKISGVKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIREGDLITVDAVNQLIEVELSDGELEKRRINWIKPIPKYKKGVLSKYSRIVSTSSLGAVTDLEK

SEQ ID NO: 279 - DNA, 1680 bp, Prochlorococcus marinus
atgaataaattaagatcatctgcaataactcaaggtgtccaaagatctcctaacagatcaatgttaagagctgttggttttagtgatgaagattttactaaacctataattggagttgctaacggatttagtactatcacaccatgcaatatgggtctaaacaagttagctctaaaagctgaagaatcaataagagaagcaggaggtatgcctcagatgttcggaaccatcaccgtaagtgatggaatctctatgggaacagagggaatgaaatattccctagtttcaagagaggttatagctgattcaatcgaaacagcatgcaatgcgcaaagtatggatggggttttagctattggaggttgtgataaaaatatgccaggagcaatgattgcaattgcaagaatgaatatcccatccatatttatttatggaggaacaataaaacctggtaaattaaatggtgaagatcttacagttgtcagtgcatttgaagctgttgggcaattaacttctgggaaaataaatgagaagagattaattgaagttgaaaaaaattgtatcccaggagctggaagttgtggaggaatgtttacagctaacactatgtctgctgttatagaagtcttgggtttaagtcttccatatagttcaacaatggcagctgaagattacgaaaaggaagttagcgctgaaaaaagtgctgaaatattagttgatgcaattagaaaagatattagacctttaactctcatgactaaagaatcatttgagaatgcaataactgtcattatggctattggaggttcaactaatgccgttctccatatattagcaatagcaaatacagcaggtatagatatcaatattgatgatttcgaaagaataagacaaaaagtacctgtaatttgcgacttaaaacccagcggtaaatacgtaacagtcgatcttcataaagcaggtggaattccacaagttatgaaaatacttctaaacacaggtttgatacatggtaattgtagaaacatagagggtaaaacagtagttgaatccttaaaagatattccagttaaacctccagagaatcaggatgtcattcgagatattgataatccactttataaaaaaggtcacttagcgattctaaaagggaacttagcctcggaaggttgtgtagccaaaattagtggaataaagaatcctgtattaaaaggacctgctcgcatctttgagagtgaggaggattgtctcaaatcaattttgaataatgatattaaagctggtaatgttgttgttataagaaatgaaggtcctgtgggcggaccagggatgagagaaatgttggcaccaacatccgcaattgttgggcaaggacttggagaaaaagtagcgctaataactgatggtagatttagtggaggcacctatggcctagttgttggccacattgcaccagaggcagcagttggaggaaatatagcgttaataaaagaaggcgatttaataactgttgatgctacaaaccaattaatcgaagttgaactatctgatgaggaattagaaatgagaagaattaactgggaaaagcctagtaaaaaatataaaaaaggagttctttctaaatattcaagaattgttagcacctcaagcctaggagccgttacagatttggaagaataa

SEQ ID NO: 280 - protein, 559 aa, Prochlorococcus marinus
MNKLRSSAITQGVQRSPNRSMLRAVGFSDEDFTKPIIGVANGFSTITPCNMGLNKLALKAEESIREAGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLIEVEKNCIPGAGSCGGMFTANTMSAVIEVLGLSLPYSSTMAAEDYEKEVSAEKSAEILVDAIRKDIRPLTLMTKESFENAITVIMAIGGSTNAVLHILAIANTAGIDINIDDFERIRQKVPVICDLKPSGKYVTVDLHKAGGIPQVMKILLNTGLIHGNCRNIEGKTVVESLKDIPVKPPENQDVIRDIDNPLYKKGHLAILKGNLASEGCVAKISGIKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIKEGDLITVDATNQLIEVELSDEELEMRRINWEKPSKKYKKGVLSKYSRIVSTSSLGAVTDLEE

SEQ ID NO: 281 - DNA, 1671 bp, Prochlorococcus marinus
atgcttcgatccagtgcaatcacccaaggaattcagagatcaccaaatagggctatgctccgagcggttggatttaatgataatgattttaacaagccaataattggtattgctaatgggtacagcacaattacaccatgcaatgttggattaaataacctagccctacacgcagaagcctcaacaaaagtatcaggcgctatgccacaaatgtttggcacaataactgttagcgatggaatatctatggggaccgaagggatgaaatattcactagtttcaagagaggttatagccgattcaatagagacagcatgtaatgctcaaagcatggacggtgttcttgcaataggaggatgtgataaaaatatgcctggagccatgattgccatggcaagaatgaatatacccgcaattttcgtgtatggagggacaattaaaccagggaaattagacggttgtgatttaacagtagtaagtgcatttgaagccgttgggcaattaacaagtggaaagattactgaagataaacttattgctgtagaaaagaattgtattcctggagcaggaagttgtggaggaatgttcacagctaataccatgtccgcagcaatagaaacgctcggattaagcttgccttatagctcaacaatggctgctgaagataaggaaaaaatagagagtgctgagcgtagtgccaaagtcctggtagatgcaattgaaaaaaatatacgtcctttagacctcctaaccaagaaatcatttgaaaatgctattgccgtagtcatggctgttggcgggtcgacaaatgccgtattacatttattagctattgctaggtcatcaggagtggacttatgcatagatgattttgaaagaattcgacagaaggtacctgtgatttgtgatttaaagccaagtggcaaatatgtcactgtagatctacataaagctggtggaatacctcaggtaatgaagctgcttttagatgcgggcttattacatggtgattgtttaactattgaaggtataactatcgatgagtccttaaaaaatatcccttcagagccaccagcgaaccaaaatgtgatatctccaatcacaaagccaatatataaaaaaggacatctagcaatcttaaaaggaaatctcgcaaccgaaggatgcgtagccaaaataagtgggattaggaccccagtgttgaaaggtccagcaaaagtatttgaaagtgaagaagactgtctcgacgcaatcttaaaagaacagatacaagaaggagatgtaatagttattagaaacgaaggccctgtaggaggacccggaatgagagaaatgttagcaccaacctctgccatagttggacaaggcctaggggataaggttgctctaataacagatggacgttttagcggtggtacttatggtttggtagtgggacatatagcaccagaagcatcagtgggagggaatatagccctagtcaaagaaggtgacatgattactgttgacgcgcacaaaaagttgattcaattggaagtagatgaaaaggagctctcaaaaaggaggactttatgggaaaaaccagaagttaaatataagactggaatactaggtaaatatgcgcgtttagttagcagttcaagcaagggtgctgtaactgatcaaccatga

SEQ ID NO: 282 - protein, 556 aa, Prochlorococcus marinus
MLRSSAITQGIQRSPNRAMLRAVGFNDNDFNKPIIGIANGYSTITPCNVGLNNLALHAEASTKVSGAMPQMFGTITVSDGISMGTEGMKYSLVSREVIADSIETACNAQSMDGVLAIGGCDKNMPGAMIAMARMNIPAIFVYGGTIKPGKLDGCDLTVVSAFEAVGQLTSGKITEDKLIAVEKNCIPGAGSCGGMFTANTMSAAIETLGLSLPYSSTMAAEDKEKIESAERSAKVLVDAIEKNIRPLDLLTKKSFENAIAVVMAVGGSTNAVLHLLAIARSSGVDLCIDDFERIRQKVPVICDLKPSGKYVTVDLHKAGGIPQVMKLLLDAGLLHGDCLTIEGITIDESLKNIPSEPPANQNVISPITKPIYKKGHLAILKGNLATEGCVAKISGIRTPVLKGPAKVFESEEDCLDAILKEQIQEGDVIVIRNEGPVGGPGMREMLAPTSAIVGQGLGDKVALITDGRFSGGTYGLVVGHIAPEASVGGNIALVKEGDMITVDAHKKLIQLEVDEKELSKRRTLWEKPEVKYKTGILGKYARLVSSSSKGAVTDQP

SEQ ID NO: 283 - DNA, 1677 bp, Prochlorococcus marinus
atgaagcttagatcaagcgcaataactcaaggcgtacagagatcgccaaacagagcaatgcttcgtgctgttgggtttgaagacgatgatttcaacaaaccaataataggtattgcaaatgggtatagcactatcacgccttgtaatattgggctaaatgatttggcaaaacaagcagaaaaagcaataaaggattgggatggtatgcctcaaatgtttggaacaattactgttagtgatggaatatctatggggactgaagggatgaaatactccttggtctctagagaagtaatagccgattcaatagaaactgcatgcaatgctcaaagcatggatggagtgttagcaataggtggttgcgataaaaacatgcctggtgcaatgctagccatggcaagaatgaatattccagggatatttgtttatgggggaacgatcaaaccaggaaaattaaatggcgaggatttgacagttgtaagtgcatttgaagctgtggggcaattaactagtgggaaaataacaaaagaaaaattgattgaggttgaaaaacattgcattccaggggctggtagttgtggaggtatgtttacagcaaacacaatgtcagcagccattgaagctatgggactaagtcttcctcacagttcaaccatggctgctgaggatcaagaaaaaataaaaagtactcaaaaaagtgccgaggttcttattaaagctatcaaggaaaatattcgcccattagatttattaaccaagcaagcattcgagaatgcaataagtgtagtaatggcagttgggggctctacaaatgctgtgcttcatcttttagcaattgctcattcatcgggagttgaactttctcttgacgaatttgaaaagatacgtcaacgagttccggtactttgtgatttaaagcccagtggtaaatatgtgactgttgacctacacaaagcaggaggcattccacaagtcatgaaaatacttcttgaagcaggattgattaatgaaaattgtagaacaatagaaaacaaaacaatcaaggaaatgctgctcgatgttcccgcagagcccccatcagatcaggatgttattcggcctttcgattcgccggtctataaaaaaggtcatttagcaattctcaaaggaaatcttgcaactgagggaagcgttgcaaaaatcagtggtataaaagaaccaatccttacaggtccagcaaaagtatttgaaagtgaagaagattgcttaaaagcaatacttactgaacaaattcactcaggtgatgtagtagtcataagaaatgaaggcccagttggtgggccagggatgagagaaatgctcgctccaacatctgcaattgttggtcaaggtcttggtgaaaaagttgctttaattactgacggacgttttagtggcggaacatatggactagtagttggtcatgtcgcaccagaagcagccgttggagggaatattgctctaattcaagatggtgacagcataactgttgatgctattcaaaaactcattcaagtaaatatcgaagaagcagaattaaaaagacgacgttcactttgggttaagccaaagcccaaatacaattcaggagttcttgggaaatatgcaactttggttagtagttcaagcaaaggtgctgtaactgatcagaactgttaa

SEQ ID NO: 284 - protein, 558 aa, Prochlorococcus marinus
MKLRSSAITQGVQRSPNRAMLRAVGFEDDDFNKPIIGIANGYSTITPCNIGLNDLAKQAEKAIKDWDGMPQMFGTITVSDGISMGTEGMKYSLVSREVIADSIETACNAQSMDGVLAIGGCDKNMPGAMLAMARMNIPGIFVYGGTIKPGKLNGEDLTVVSAFEAVGQLTSGKITKEKLIEVEKHCIPGAGSCGGMFTANTMSAAIEAMGLSLPHSSTMAAEDQEKIKSTQKSAEVLIKAIKENIRPLDLLTKQAFENAISVVMAVGGSTNAVLHLLAIAHSSGVELSLDEFEKIRQRVPVLCDLKPSGKYVTVDLHKAGGIPQVMKILLEAGLINENCRTIENKTIKEMLLDVPAEPPSDQDVIRPFDSPVYKKGHLAILKGNLATEGSVAKISGIKEPILTGPAKVFESEEDCLKAILTEQIHSGDVVVIRNEGPVGGPGMREMLAPTSAIVGQGLGEKVALITDGRFSGGTYGLVVGHVAPEAAVGGNIALIQDGDSITVDAIQKLIQVNIEEAELKRRRSLWVKPKPKYNSGVLGKYATLVSSSSKGAVTDQNC

SEQ ID NO: 285 - DNA, 1707 bp, Nodularia spumigena
atggaaggaaaaaaaatgtcggagaatttaagaagccaagttgttacccaaggagtgcagcgatcgcctaatcgagctatgctgcgtgcagtgggttttaaggacgaagattttaataaagccattgtcggcattgctaatggctacagtacaatcactccctgcaatatgggaattaataaactagcactaagagccgaaattggcgtaagagaagctggggcaatgccgcaaatgttcggtactatcaccattagtgatgggatttctatgggaaccgaggggatgaaatattccctagtgtcacgagaagttattgctgattccattgaaaccgcctgtactggacaaagtatggatggcgttttggctattggtggctgtgataaaaatatgccaggggcaatgctagcgatggcgcgcatgaatattcctgctatttttgtttatggtggcacaattaaacccggtcactacgatggtaaagatttaaccgtcgtgagttcctttgaagcagttggtcaatacagcgccggtaaaattgatggtgatgaactcttagcagtggaacgtgaagcttgtcctggtgctggttcctgcggtgggatgtttacagcaaataccatgtcttccgcttttgaagcaatgggcatgagcttaccttattcttccacaatggcagccgaagatgctgaaaaagccgacagtacgcaaaaatcagcagttgctttagtagaagccatacgtaagcaaatcttacctcggcagattatcacccgtaaatctatagaaaatgccatttcagtaattatggcagtgggtggttccacaaatgcagtattgcactttttagcgatcgctcgtgcagctggagtagaactcacactagatgattttgaaaccatccgtggacgtgtcccagttatctgtgatttaaaacccagtggtaaatatgtcgccacagacctgcacaaagctggcggaatacctcaagtcatgaaaatgttacttgtgcatgatttactccacggcgactgcttaactatcacaggtaaaacagtagcagaagtcttagcagatatctccgcagaaccacgtaccgaccaagatgtgattcgtccttggaataaccccatgtatgctcaaggacacttagccatcctcaaaggcaacctagccacagaaggggctgtagccaaaatcaccggagttaaaaagccgattattactggccctgcacgggtatttgagtctgaggaatcctgtttagatgccatcctcgcaaataaaattaatgccggggatgttctcataattcgttacgaaggtcccaagggtggccctggtatgagagaaatgcttgctcccacctcagcaattattggggctgggttaggcgatgcagtaggtttaattactgatgggcgcttttccggcggtacttacggcatggtagttggtcacgtagccccagaagcagccgttggtggtgcgatcgctcttgtagaagaaggtgatagcattaccattgatgcctctaatcgcctcttgcaattgaacgtctcagatgaagaattagcccgtagacgtgccaattggcaaccccttccaccccgttacaccaaaggcgtacttgctaaatatgccaaattagtatcttctagcagtgttggagcagtcacagatttagacttatttaatggttag

SEQ ID NO: 286 - protein, 568 aa, Nodularia spumigena
MEGKKMSENLRSQVVTQGVQRSPNRAMLRAVGFKDEDFNKAIVGIANGYSTITPCNMGINKLALRAEIGVREAGAMPQMFGTITISDGISMGTEGMKYSLVSREVIADSIETACTGQSMDGVLAIGGCDKNMPGAMLAMARMNIPAIFVYGGTIKPGHYDGKDLTVVSSFEAVGQYSAGKIDGDELLAVEREACPGAGSCGGMFTANTMSSAFEAMGMSLPYSSTMAAEDAEKADSTQKSAVALVEAIRKQILPRQIITRKSIENAISVIMAVGGSTNAVLHFLAIARAAGVELTLDDFETIRGRVPVICDLKPSGKYVATDLHKAGGIPQVMKMLLVHDLLHGDCLTITGKTVAEVLADISAEPRTDQDVIRPWNNPMYAQGHLAILKGNLATEGAVAKITGVKKPIITGPARVFESEESCLDAILANKINAGDVLIIRYEGPKGGPGMREMLAPTSAIIGAGLGDAVGLITDGRFSGGTYGMVVGHVAPEAAVGGAIALVEEGDSITIDASNRLLQLNVSDEELARRRANWQPLPPRYTKGVLAKYAKLVSSSSVGAVTDLDLFNG

SEQ ID NO: 287 - DNA, 1701 bp, Nostoc punctiforme
atgtcggagaatttgagaagccaagtagtgacgcaaggagtgcagcgatcgccaaatcgagctatgctgcgggcagttggttttaaagatgaagatttcaataaagccattgtcggtatagccaacggttacagcacgatcaccccctgcaatatggggataaatcaactggcacagagggcagaagctgggattaaaaccgccggagcaatgccgcaaatatttggcacaattaccatcagcgacgggatttcaatgggaaccgaagggatgaaatattccctagtatcgcgggaagttatcgccgattccatcgaaaccgcctgtaccggacaaagtatggatggtgtactagccattggtggctgtgataagaatatgccaggcgcaatgctagcgatcgcgcggatgaatatcccggcaatattcgtttacggtggcacaattaaacccggtcactacaacggacgcgatttaaccgttgtcagttcttttgaagctgttggtcaatacagtgcgggaaaaattgacgacaaggaattattagaagtcgaaagtcgcgcttgtcctggcgctggttcctgcgggggaatgttcacagctaacaccatgtcttcagcatttgaagcgatgggaatgagtttaccctattcttccacaatggcagccgaagatgccgaaaaagccgacagcacggaaaaatcagcctttgtgctagtcgaagccatcaagaagcaaatcttaccccggcaaattatcacccgtaaatctatagagaatgccatctctgtgattatggcggtgggtggttcgaccaatgcagtattgcatttcttagcgatcgcccgcgctgcgaatgtagagttaaccctagatgactttgaaacaatccgcgcccgtgttcccgttttgtgcgatctaaaaccaagcggtaaatatgtcgctacagatttgcacaaagctggtggcattccgcaagtcatgaagatgctactcgcacatggcttattgcatggtgatagtctcaccattagcggtcaaaccattgcagagatattagcagacatacccgaagagccatctgccaatcaagatgtgattcgggcttggaataacccgatgtatgctcaaggacatttagccatcctcagaggtaatctggcaacggaaggggctgtcgctaaaattaccggcgtgaaaaaaccagtcattaccgggcctgcacgggtgtttgagtcggaagaagcctctttagatgcaattttggcgggtaaaattcaagctggtgatattttggttattcgctacgaagggcccaaaggcggccctggaatgcgagaaatgttggctcccacttcggcaattatcggggctggcttgggtgatgcggtgggattaattaccgatgggcgcttttctggcggtacttatggcatggtggttggtcatgttgctccagaagcagcagtgggtggtgcgatcgcgcttgttgaagaaggcgatagtattaccattgatgcacccgcacgccttttgcagttgaatatatctgaagaagaattagctcgtcgtcgtgctaattggcaacctcccgctccacgttacaccaaaggcgtgttggcgaaatatgccaaactggtatcttctagcagcatcggtgctgtgacagatttggatttgttcaaaccacaacagaactaa

SEQ ID NO: 288 - protein, 566 aa, Nostoc punctiforme
MSENLRSQVVTQGVQRSPNRAMLRAVGFKDEDFNKAIVGIANGYSTITPCNMGINQLAQRAEAGIKTAGAMPQIFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESRACPGAGSCGGMFTANTMSSAFEAMGMSLPYSSTMAAEDAEKADSTEKSAFVLVEAIKKQILPRQIITRKSIENAISVIMAVGGSTNAVLHFLAIARAANVELTLDDFETIRARVPVLCDLKPSGKYVATDLHKAGGIPQVMKMLLAHGLLHGDSLTISGQTIAEILADIPEEPSANQDVIRAWNNPMYAQGHLAILRGNLATEGAVAKITGVKKPVITGPARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISEEELARRRANWQPPAPRYTKGVLAKYAKLVSSSSIGAVTDLDLFKPQQN

SEQ ID NO: 289 - DNA, 1692 bp, Nostoc sp.
atgtcggagaattttagaagcaaggctatcacacaaggggtacagcgatcgcctaacagagcaatgctgcgggctgttggttttcaggatgcagattttaccaaagccattgtaggtgttgccaatggttacagcacgattaccccgtgtaatatggggataaatcaactagcacaaagggcagaagctggtataaatactgctggagcaaagccgcaaatattcggtacaattacgattagtgatgggatttcgatgggaaccgaagggatgaaatattccctggtatcacgagaagtaatcgctgactccattgaaaccgtttgtaatgggcaaagtttagacggggtaattgccattggtggctgtgataagaatatgccaggggcaatgattgcgatcgcccggataaatatccctgctatctttgtttacggtggcacaattaaacccggacattacaacggtaaagatttaactgttgtcagttcttttgaggctgttggtgagtacagcgccggtaaaattgacgaaaatgaactgttagcagtagaacgcaatgcttgtcctggtgcaggttcctgcggtgggatgtacacagcaaataccatgtcctctgcttttgaagcactggggatgagtttgccctattcgtctacaatggcggcagaagatgacgaaaaagctgatagtacggaagaatcagccaaggtattggtagaggcgattcgtcatcaattattacccagacagattatcactcgtaagtccatagaaaacgccatatctgtaattatggctgtgggtggttctactaatgcggtgttacattttctagcgatcgcccgtgcggctggtgtagaactaaatctggacgactttgaaactattcgtggtcgtgtccccgttttgtgcgacttgaaaccaagcggtagatatgtggctacagacctgcacaaagctggtggtataccccaagtcatgaaaatgttactcgtgcatggtttactccacggcgactgtatgaccatcacaggtaaaaccattgccgaagttttagcagatatcccagaagaaccatcgcctaatcaagatgtaattcgtccttggaataaccccatgtatgcccaaggccacttggctatactcaaaggtaatttggcaacagaaggcgcagttgccaaaattactggtgtgaaaaatcctgtgattacagggccagccaaagtatttgaatcagaagaggattgtttagatgcaattttggcaggtaaaattaaagccggtgacgtgattgtcatccgctacgaaggccccaaaggcggccctgggatgcgagaaatgttagcccccacctcagctattatcggtgcaggtttaggcgactcagtgggactaattaccgatggacgcttctccggtggtacttacggtatggttgtgggacacgttgcaccagaagcagccgttggtggggcgatcgctctggtacaagaaggtgatagcatcacaattgatgcccacgcccgttctttgcagttgaacatatcagacgaagaattaacccgtcgtcgtgccaattggcaaccccgtcccccacgttacactacaggcatactggcaaaatacgccaagttggtagcttctagtagtgtgggtgctgtcaccgatttagacttattcaataaatag

SEQ ID NO: 290 - protein, 563 aa, Nostoc sp.
MSENFRSKAITQGVQRSPNRAMLRAVGFQDADFTKAIVGVANGYSTITPCNMGINQLAQRAEAGINTAGAKPQIFGTITISDGISMGTEGMKYSLVSREVIADSIETVCNGQSLDGVIAIGGCDKNMPGAMIAIARINIPAIFVYGGTIKPGHYNGKDLTVVSSFEAVGEYSAGKIDENELLAVERNACPGAGSCGGMYTANTMSSAFEALGMSLPYSSTMAAEDDEKADSTEESAKVLVEAIRHQLLPRQIITRKSIENAISVIMAVGGSTNAVLHFLAIARAAGVELNLDDFETIRGRVPVLCDLKPSGRYVATDLHKAGGIPQVMKMLLVHGLLHGDCMTITGKTIAEVLADIPEEPSPNQDVIRPWNNPMYAQGHLAILKGNLATEGAVAKITGVKNPVITGPAKVFESEEDCLDAILAGKIKAGDVIVIRYEGPKGGPGMREMLAPTSAIIGAGLGDSVGLITDGRFSGGTYGMVVGHVAPEAAVGGAIALVQEGDSITIDAHARSLQLNISDEELTRRRANWQPRPPRYTTGILAKYAKLVASSSVGAVTDLDLFNK

SEQ ID NO: 291 - DNA, 1686 bp, Trichodesmium erythraeum
atgccagagaatttgagaagtcaattagtcaccaaaggagtacaacgcgctcccaaccgagctatgctgagagctgtgggttttgaagattcagactttaccaaaccaattattggggttgccaatgcccatagcactattactccctgcaacatgggtattaatgatttggccatgagagctgtaagtggagtgaaagaagctggaggaatgccgcagatatttggaactattactattagcgatggaatttctatgggtactgaggggatgaaatattctctggtttctagagacgttattgctgattccatcgaaacagtttgtaatggccaaacaatggatggagttctagctattggtggatgcgataaaaatatgccaggagcaatgatagcgatcgctaggatgaatattcctgctatcttcgtatacggtggtactattaaaccaggcaactacaacggtaaagacctaacagttgtaagtgcttttgaagcagtgggagaatatagtgctggaaaaattgacgaaacagaattaacagaagttgaacgtagagcttgccctggtgctggttcctgtggaggaatgtttactgccaatactatgtcttcagcttttgaagcaatgggtatgagtctcatgtattcatcaacaatggctgcagaagatgcagaaaaagcagatagcacagaaaaatcagctcatgttttagtagaagctattcgcaaacaaattttacctagtcaaattattacccgtaaagctatcgaaaatgcaatttcagtaattatggctgtagggggttccactaatgcagtactacacctattagcaattgcttatgctgcaaatgtgaagttatctttagatgattttgaaataattagggccagagtacctgtattatgtgatttgaaacctagtggtaaatacgttacaacaaatttgcatcaagcgggtggaattcctttagtaatgaaaatgcttttagaacatgatttactccacccagatgctttaaccataacaggtaagactattggagagcaattaacaaatataccttctgaaccaccttctaatcaagacgtgattcgcccttggaataatcctatgtatgctcaaggacacttggctattttaaaaggaaatttggcgacagagggagcagttgctaaaattacaggagtgaagaacccagaaataacaggactagcaagagtatttgattcggaagaagcttgtttagaagcaatattagcagggaaaattcaagcagggaatattattgtagttcgctatgaaggtccaaaaggtggaccaggtatgcgagaaatgttagcaccaacttcggctattattggtgctggtttgggggataaagtgggattaattactgatggtaggttttctggtggtacttatggtatggtggttggtcatgtagctccagaagctgcagtaggtggcacgatcgctctagttaaggaaggagatatgattactattgatgctcataagcgtttactacagttaaatatttctgatgaggaattagaaaagcgtcgtcaagtatggaaaccacgaaaaccccaatatactagaggtgtattagctaaatatgctaagttagtttcttctagcagtgttggagcagtaactgacgctggattaggttga

SEQ ID NO: 292 - protein, 561 aa, Trichodesmium erythraeum
MPENLRSQLVTKGVQRAPNRAMLRAVGFEDSDFTKPIIGVANAHSTITPCNMGINDLAMRAVSGVKEAGGMPQIFGTITISDGISMGTEGMKYSLVSRDVIADSIETVCNGQTMDGVLAIGGCDKNMPGAMIAIARMNIPAIFVYGGTIKPGNYNGKDLTVVSAFEAVGEYSAGKIDETELTEVERRACPGAGSCGGMFTANTMSSAFEAMGMSLMYSSTMAAEDAEKADSTEKSAHVLVEAIRKQILPSQIITRKAIENAISVIMAVGGSTNAVLHLLAIAYAANVKLSLDDFEIIRARVPVLCDLKPSGKYVTTNLHQAGGIPLVMKMLLEHDLLHPDALTITGKTIGEQLTNIPSEPPSNQDVIRPWNNPMYAQGHLAILKGNLATEGAVAKITGVKNPEITGLARVFDSEEACLEAILAGKIQAGNIIVVRYEGPKGGPGMREMLAPTSAIIGAGLGDKVGLITDGRFSGGTYGMVVGHVAPEAAVGGTIALVKEGDMITIDAHKRLLQLNISDEELEKRRQVWKPRKPQYTRGVLAKYAKLVSSSSVGAVTDAGLG

SEQ ID NO: 293 - DNA, 1686 bp, Acaryochloris marin
atgtctgacaatcgaaatagccaagtcgtcactcaaggagttcaacgagcccccaaccgggccatgctaagggctgtgggctttggagatgatgattttaccaagccgattgttgggttagcgaatggttttagtacgattaccccttgtaatatgggcatagactctctggctacacgggcagaggccagtatcagaacggctggagccatgccgcaaaagtttggcaccatcactatcagtgacggcatttccatgggcacggaagggatgaaatattccttggtgtcccgggaagtgattgcagactccatcgagacggcctgtatgggccaaagtatggatggagtactcgccattggcggctgtgataaaaatatgccgggggctatgctcgccatggctcggatgaatattccggccatctttgtttacggcggcacgatcaaacccggacatctaaatggtgaagacttaaccgtggttagtgcctttgaagctgtgggtcagcatagtgctggacggattagtgaagccgagttaacggcagtggagaaacatgcttgtccgggtgctggatcctgtggcggtatgtatacggccaacaccatgtcttctgcgtttgaggcaatgggcatgagcctgatgtattcttccaccatggcagcggaagatgaagaaaaagccgtcagtgcagaacagtctgccgctgttttagtggaagcgatccacaagcaaattctgccccgcgatatcttgacccgcaaagcctttgaaaatgccattgctgtgattatggctgtaggcggatccaccaatgccgttctccacctgttggccatttcccgcgcggctggagactccctgaccctagatgacttcgaaaccatccgggctcaagttccagtgatctgcgatctcaaaccatcaggtcgctatgtagccacagatctccataaagcaggtggaatcccattggtgatgaaaatgctattggaacatggtcttctccatggtgatgctctgaccattacgggtaaaaccattgctgagcagttggctgatgtcccatcagagccttcccccgatcaggatgtaattcggccttgggacaatcccatgtataaacaaggccacctcgccatcctccggggtaacttggccacggaaggagcggttgccaaaatcacaggcattaaaaatccccaaattacgggtccagctcgggtatttgaatcggaagaggcttgcttggaggcgattttggcaggcaagattcagcctaatgatgtgattgtggtgcggtatgaaggcccgaagggtgggccgggaatgcgagagatgttagctcccacgtccgcgattattggggcaggtttgggtgattcagttggattgattacggatggtcgcttttctggtggaacttacggcatggtggttgggcatgtggccccagaagctgcggtgggtggtacgattgcccttgtgcaggaaggcgatcagattacaattgatgcccatgctcgaaagttggagctgcatgtgtctgatcaggagttaaaagagcggaaggagaagtgggagcaaccaaaacctctctataacaaaggggttttggcaaagtatgccaagttagtttcttctagtagtgttggagctgttactgatttagatctattttga

SEQ ID NO: 294 - protein, 561 aa, Acaryochloris marin
MSDNRNSQVVTQGVQRAPNRAMLRAVGFGDDDFTKPIVGLANGFSTITPCNMGIDSLATRAEASIRTAGAMPQKFGTITISDGISMGTEGMKYSLVSREVIADSIETACMGQSMDGVLAIGGCDKNMPGAMLAMARMNIPAIFVYGGTIKPGHLNGEDLTVVSAFEAVGQHSAGRISEAELTAVEKHACPGAGSCGGMYTANTMSSAFEAMGMSLMYSSTMAAEDEEKAVSAEQSAAVLVEAIHKQILPRDILTRKAFENAIAVIMAVGGSTNAVLHLLAISRAAGDSLTLDDFETIRAQVPVICDLKPSGRYVATDLHKAGGIPLVMKMLLEHGLLHGDALTITGKTIAEQLADVPSEPSPDQDVIRPWDNPMYKQGHLAILRGNLATEGAVAKITGIKNPQITGPARVFESEEACLEAILAGKIQPNDVIVVRYEGPKGGPGMREMLAPTSAIIGAGLGDSVGLITDGRFSGGTYGMVVGHVAPEAAVGGTIALVQEGDQITIDAHARKLELHVSDQELKERKEKWEQPKPLYNKGVLAKYAKLVSSSSVGAVTDLDLF

SEQ ID NO: 295 - DNA, 1683 bp, Lyngbya sp.
atgtcagataactttagaagtcaagccatcacccaaggaaagaaacgcacaccgaaccgggcgatgctccgagcggtagggtttggggatgaggactttaataagcctattgtcggcattgctaatggttacagtaccattactccctgcaacattggattgaacgatttggcgcatcgtgctgaaacggcattaaaacaagccgacgctatgcctcaaatgtttgggacgattactgttagtgatggcattgccatgggaaccgaggggatgaaatattctctggtttcccgagaggtgatcgccgatgcgattgaaactgcttgtaatgggcagagtatggatggcgttttggcgattggcggttgtgataaaaatatgcctggggcgatgattgcgatcgcgaggatgaatattccggcaatttttgtgtatggcggtacgattaaaccggggaatttaaacggttgtgatttaacggttgtcagtgcgtttgaggctgtcggcgaatacagcgccgggaaacttgatgatgatcgcttactcgatattgaacgccttgcttgtccgggttcggggtcttgtgggggaatgtttacggcaaatactatgtcttcggcgtttgaagcgatggggatgagtttaatgtattcttccacaatggcttctgaagatgcggaaaaggctgatagtaccgaaaagtctgcgtttgtgttgcgtgaggcgattagtcaacggattttaccgaagcaaattctcacccgcaaggcgtttgaaaatgcgatcgctgtgattatggcggtgggcggttcgacaaactcggtattacacttgttggcgattgcttatgcagcagatgtggaactgacgattgatgattttgaaacaattcggggacgggttccggttttatgtgatcttaaacccagtgggcgatttgtcacgacggattttcacaaagcgggtggcgttccgctgattatgaaaatgcttctcgaacagggtttaattcatggtgatgctttaacgattaccgggaaaacggttgccgaacagttggctgatattccctctcaaccgtctgcggatcaagaggtgattcgcccctggaataatccgatgtacaagcaagggcatttagcgattttgaagggaaatctcgccacagaaggcagtgttgctaaaattacaggcgtgaaaaaaccgcaaatgactggccccgcacgggtatttgagtcggaagaacagtgtttagaggcgattttagcgggtaaaattcaagctggagatgttttggtggttcgctatgaaggccccaaaggtggccccggaatgcgagaaatgttggcgccgacttccgcaattattggggcaggcttaggggattctgtgggcttgattaccgatggacggttttcggggggaacttatggcttggttgtcggtcatgttgccccagaagctgccgttggtggtaatattgcgttggttcaagagggcgatagtattacgattgatgcttcacaacggttattgcaggtgaatatttctgatcaggtattggaacaacgccgtcaaaattggcaaccgcctcaacctcgttacacaaaaggtgttttagctaaatatgcgaagttagtgtcttcgagtagtgtgggggcggtgacggatttagactgttaa

SEQ ID NO: 296 - protein, 560 aa, Lyngbya sp.
MSDNFRSQAITQGKKRTPNRAMLRAVGFGDEDFNKPIVGIANGYSTITPCNIGLNDLAHRAETALKQADAMPQMFGTITVSDGIAMGTEGMKYSLVSREVIADAIETACNGQSMDGVLAIGGCDKNMPGAMIAIARMNIPAIFVYGGTIKPGNLNGCDLTVVSAFEAVGEYSAGKLDDDRLLDIERLACPGSGSCGGMFTANTMSSAFEAMGMSLMYSSTMASEDAEKADSTEKSAFVLREAISQRILPKQILTRKAFENAIAVIMAVGGSTNSVLHLLAIAYAADVELTIDDFETIRGRVPVLCDLKPSGRFVTTDFHKAGGVPLIMKMLLEQGLIHGDALTITGKTVAEQLADIPSQPSADQEVIRPWNNPMYKQGHLAILKGNLATEGSVAKITGVKKPQMTGPARVFESEEQCLEAILAGKIQAGDVLVVRYEGPKGGPGMREMLAPTSAIIGAGLGDSVGLITDGRFSGGTYGLVVGHVAPEAAVGGNIALVQEGDSITIDASQRLLQVNISDQVLEQRRQNWQPPQPRYTKGVLAKYAKLVSSSSVGAVTDLDC

SEQ ID NO: 297 - DNA, 1686 bp, Synechocystis sp.
atgtccaacaatcccagaagccaggtaattacccagggcacccaacggagtcccaaccgggccatgctccgggccgttggttttggcgatgatgactttacgaaacccattgtgggtattgccaacgggtacagcaccattaccccctgcaacatgggcattaatgatctggctctacgggccgaggccggcttacggacagcgggggccatgccccaattgtttggcactatcaccatcagtgacggtatttccatgggtacggaagggatgaaatattccctagtttcccgggaagtgattgctgattccatcgaaacagtatgcaatggccaacgcatggacggagttttggcgatcgggggctgtgataagaatatgccgggggcaatgattgccatggctcgcctcaatattccctctatctttgtttacggtggcactattaaacccggacattatgccggggaagatttaacagtggtcagtgcctttgaagcggtgggccagtacagcgctggcaaaattgatgaggaaaccctctacggcattgaacggaatgcctgtcctggggctggttcctgtggggggatgttcaccgccaacaccatgtcctccgcctttgaagctatggggatgagcttgccctattcttctaccatggccgcagtggatggggaaaaagccgacagcaccgaggagtccgccaaggttttggtggaagccatcaaaaaacagattttgcccagtcaaattctgacccggaaagcttttgaaaatgccattgccgtgattatggccgtggggggctccactaatgcagtgctccatctgctggcgatcgccaacaccattggggtgcccctaagcttggacgattttgaaaccattcgccacaaagtacctgtactgtgcgacctcaaaccttccggcaaatacgtcaccactaatctccacgccgccggtggcattccccaggtgatgaaaatattgctggtcaatggcattctccacggtgacgctttaacgattacaggacagaccattgctgaagttttagccgatattcctgaccaaccccctgccggccaggacgtaatccattcctgggatgaccctgtttatcaagaaggtcacctggcagtgctcaaaggtaacctggccaccgaaggcagtgtggctaaaatcagcggtgttaaaaagccggtgatcactggtcccgccaaagtatttgaatctgaagaagattgcctagaagcgattctagccggcaaaattcaagcaggagatgtggtggtcgtgcgctatgaagggcccaaaggtggccccggtatgcgggaaatgctagcccccacttctgccatcattggggcagggttgggagactccgttggcctaatcaccgatggccgcttttctggtggtacctatggcttagtggtgggtcacgttgcccccgaagcttatgtgggaggggcgatcgccttggtgcaagagggggatcaaatcaccatcgatgctggcaagcggttactgcaactcaacatcagtgaagaggaattggcccaacggcgggcccaatggactcctcctcagccccgctatccccgggggattttagccaagtatgccaagttagtttcctccagcagccttggtgcagtgactgatatagacttgttctaa

SEQ ID NO: 298 - protein, 561 aa, Synechocystis sp.
MSNNPRSQVITQGTQRSPNRAMLRAVGFGDDDFTKPIVGIANGYSTITPCNMGINDLALRAEAGLRTAGAMPQLFGTITISDGISMGTEGMKYSLVSREVIADSIETVCNGQRMDGVLAIGGCDKNMPGAMIAMARLNIPSIFVYGGTIKPGHYAGEDLTVVSAFEAVGQYSAGKIDEETLYGIERNACPGAGSCGGMFTANTMSSAFEAMGMSLPYSSTMAAVDGEKADSTEESAKVLVEAIKKQILPSQILTRKAFENAIAVIMAVGGSTNAVLHLLAIANTIGVPLSLDDFETIRHKVPVLCDLKPSGKYVTTNLHAAGGIPQVMKILLVNGILHGDALTITGQTIAEVLADIPDQPPAGQDVIHSWDDPVYQEGHLAVLKGNLATEGSVAKISGVKKPVITGPAKVFESEEDCLEAILAGKIQAGDVVVVRYEGPKGGPGMREMLAPTSAIIGAGLGDSVGLITDGRFSGGTYGLVVGHVAPEAYVGGAIALVQEGDQITIDAGKRLLQLNISEEELAQRRAQWTPPQPRYPRGILAKYAKLVSSSSLGAVTDIDLF

SEQ ID NO: 299 - DNA, 1686 bp, Cyanothece sp.
atgtctgagaatgcaagaagtcgcctcattaccgagggaagtcaacgaacccctaaccgtgccatgttgcgtgctgtgggcttcggagatgatgattttaataagcctattgttggggtagctaatggcttcagtaccataaccccttgtaacatggggattaatgacctagctaaacgtgctgaagcaggaattaaaaccgctggtgggatgcctcagatattcggtaccattaccatcagtgatggcatttctatgggaaccgaaggcatgaaatattccctcgtctcacgggatgttattgccgactctatcgaaaccgtttgtaatggtcaaagcatggatggagtgatcgctattggtggatgcgacaagaatatgccaggggcaatgatagccatggcaagaatgaatatacctgcaatctttgtctatggaggaaccattaaacccggccattacaacggggaagatttaacagtagtcagtgcctttgaagcggtcggccaacatagtgcaggtaagatagatgatagcacattattggctattgaacgtaatgcttgccccggtgccggttcctgtgggggaatgttcaccgcaaataccatgtcttcagcgtttgaagtgatgggaatgagtttaccttattcttctacgatggcagcagaagatgcagaaaaagcagacagtacagaaaagtcagcttttgctttagttaatgccattcgtaaccagattttacccagtcacattttaacccgaaaagcctttgaaaatgccatttctgtaatcatggcggtgggaggttctacgaatgctgtattacaccttttagcgatcgctaataccatcggtgttgacctaactttagacgattttgaaaccattcgtcaacgggttcctgtactctgtgatttaaaaccatcgggacgctatgtaacggttaatttgcatgaagcgggtggcattcctcaagtgatgaaactattattaaatcatggattattacatggggatgcgttaacgatttccggtcaaactatagcagaaattttagccgatgtaccggatgaacctccagcgaatcaagatgttattcggacttgggataaccctgtttataaagagggacatttagccattttaaaaggtaatttagcctctgagggtgcagttgccaaaattagtggggtaaagaatcccaaaataacaggtccggcgcgagtttttgagtcggaagaggaatgtttagaggcaattttagcaggaaaaattaacgctggtgatgtcattattgtccgttatgaaggtcctagaggaggcccaggaatgcgagaaatgttagcaccaacttctgcaattattggggctggtttaggtgattccgtgggcttaattaccgatggccggttttctgggggaacctatggtttagtggtgggtcatgttgccccagaagcttacgtagggggtactattggcttagtaaaagaaggggatagtattaccattgatgctaaagaaaaactccttcaagtcaatgtttctgaagaagaattaaaccaacgtcgggctaattggaaagctcccgaacctcgttataaaagaggggtattaggtaagtatgccaagttagtttcttctagtagtttaggggcagttactgacgtgaatttgttttaa

SEQ ID NO: 300 - protein, 561 aa, Cyanothece sp.
MSENARSRLITEGSQRTPNRAMLRAVGFGDDDFNKPIVGVANGFSTITPCNMGINDLAKRAEAGIKTAGGMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQHSAGKIDDSTLLAIERNACPGAGSCGGMFTANTMSSAFEVMGMSLPYSSTMAAEDAEKADSTEKSAFALVNAIRNQILPSHILTRKAFENAISVIMAVGGSTNAVLHLLAIANTIGVDLTLDDFETIRQRVPVLCDLKPSGRYVTVNLHEAGGIPQVMKLLLNHGLLHGDALTISGQTIAEILADVPDEPPANQDVIRTWDNPVYKEGHLAILKGNLASEGAVAKISGVKNPKITGPARVFESEEECLEAILAGKINAGDVIIVRYEGPRGGPGMREMLAPTSAIIGAGLGDSVGLITDGRFSGGTYGLVVGHVAPEAYVGGTIGLVKEGDSITIDAKEKLLQVNVSEEELNQRRANWKAPEPRYKRGVLGKYAKLVSSSSLGAVTDVNLF

SEQ ID NO: 301 - DNA, 1683 bp, Thermosynechococcus elongatus
atggcagaaaattggcgcagtcgcatcatcacagaaggcattcaacgcacccccaaccgagccatgctgcgagccgtgggttttggtgacgaggattttaacaagcccattgtgggggtggccagtgcccacagcacaattacgccctgcaacatggggattgctgcccttgccagtcgcgccgaagcaggaattcgggccgcgggagggatgccgcaattgtttggcaccattacggtcagcgatggtatttccatgggcactgaagggatgaaatactctttggtctcgcgggatgtgattgctgattcgattgagactgtctgtaatgcccagagtatggatggggtgctggcgatcggtggctgtgacaagaatatgcctggcgccatgattgccatggcacggatgaacattccagccatttttgtctatgggggtacgattaagcccggtcattggcaggggcaagaccttacggttgtcagcgcctttgaggccgtaggtcagtttagtgccggcaaaatggatgaggcaacgctccatgccattgaacaccatgcctgtccgggggcgggctcctgtggcgggatgttcacagccaatacgatgtcctcggcctttgaggccatgggcatgagtttaatgtattcctcaacgatgacggcggaagatgccgaaaaagctgacagcactgagttggcgggcaaggtgctggtggaggcaatccgcaaaaatattcgcccccgtgacattattacccgcaaatccattgaaaatgccatcagtgtgattatggctgtggggggatccacaaatgccgtgctgcattttctggcgatcgcccacagtgccgaggttcccttgaccattgatgattttgaaacgattcgccagcgggtgcccgttctctgcgacctcaagccctcgggtaaatacgtcactgcggatctacatcgggcagggggcattccccaagtcatgaaaatgctcctcaatgccggattgctccacggggattgcctaacgattactggagaaaccattgccgagcggctgcggcatgtgcccgatacccccgaccccaaccaagatgtgattcgtccttttgatcaacccttgtatgccacgggtcacctggctattctcaagggcaatctagccagcgaaggtgctgtagccaaaatctccggggtgaaaaatccccaaattaccgggcctgcccgcgtctttgactccgaggaagactgccttgacgccattctggcgggcaagatcaaccccggcgatgtcattgtcattcgctatgaaggccccgtcggcggtccggggatgcgggaaatgctggctcccacctctgccattattggtgcgggtttaggggatagtgttggcctcattaccgatggtcgcttttccggaggcacctatggcatggtcgtcggtcatgtggcgccggaagcggcagttggtgggacgatcgcccttgtgcaggagggagattcgattaccattgacgcccatcggcggctcctacaactgaatgtcagtgaggaagaactggcggcgcggcgggctaaatggcagccccctgcccctcgctacacccgtggtgtcttggctaaatatgccaaactagtgtcctctagtagtctgggagcggtgacggatcgctttgtctag

SEQ ID NO: 302 - protein, 560 aa, Thermosynechococcus elongatus
MAENWRSRIITEGIQRTPNRAMLRAVGFGDEDFNKPIVGVASAHSTITPCNMGIAALASRAEAGIRAAGGMPQLFGTITVSDGISMGTEGMKYSLVSRDVIADSIETVCNAQSMDGVLAIGGCDKNMPGAMIAMARMNIPAIFVYGGTIKPGHWQGQDLTVVSAFEAVGQFSAGKMDEATLHAIEHHACPGAGSCGGMFTANTMSSAFEAMGMSLMYSSTMTAEDAEKADSTELAGKVLVEAIRKNIRPRDIITRKSIENAISVIMAVGGSTNAVLHFLAIAHSAEVPLTIDDFETIRQRVPVLCDLKPSGKYVTADLHRAGGIPQVMKMLLNAGLLHGDCLTITGETIAERLRHVPDTPDPNQDVIRPFDQPLYATGHLAILKGNLASEGAVAKISGVKNPQITGPARVFDSEEDCLDAILAGKINPGDVIVIRYEGPVGGPGMREMLAPTSAIIGAGLGDSVGLITDGRFSGGTYGMVVGHVAPEAAVGGTIALVQEGDSITIDAHRRLLQLNVSEEELAARRAKWQPPAPRYTRGVLAKYAKLVSSSSLGAVTDRFV

SEQ ID NO: 303 - DNA, 1698 bp, Synechococcus sp.
atggccaattcccctttcccgctgcgcagccaagtggttacccagggagtacagcgctcccccaaccgcgccatgctcagggccgtaggctttcgcgacgaagacttcggcaagcccattgtcggcattgccaacgcccacagcaccctcaccccctgcaacatggggatccaaactctggcggagcgggcggaggcggctttgagaacggcgggctgtatgccccaggtgttcggcaccatcaccattagcgacggcatctcgatgggcacggaggggatgaaatactccctggtgtcgcgggaagtgattgccgattccatcgagacggtggtcaacggccagagcatggatggcctcttggccattggcggctgcgacaagaacatgccgggggcgatgatcgccatggcccgcctcaatgtgccctccatcttcgtctacggcggcaccatcaagccgggtcactacaatggccgcgacctcaccatcgtcagcgcctttgaagcggtgggggagttcagtgccgggcgcatctccgaggaagagctgctggcggtggagcgccatgcctgtcccggtgccggatcctgcggcggcatgtacacggccaacaccatgtccagcgcgtttgaggctatggggatgagtctgccctactcctccaccatggctgcagaagacgaagagaaagccgaaagtgccgcccaatcggccaaggtcttggcagaggccatcaaagccaacatccgcccccgcgacatcatcacccgtaaaagcattgaaaatgccatctcggtgatcatggccgtagggggatccaccaacgccgtgctccactttctggccattgcccatgcggcagaagtgcccctgacgctagatgatttcgagaccattcgtgctcgcgtgcctgtcctctgcgatctcaagccttcagggcggtttgtggccaccgacctgcaccgggccggtgggatcccccaggtgatgaaaatgctgctcaaccacggcctgctgcacggggactgcctcaccatctccggccagaccatcgtcgaagtcctgcgggatgtgccggacgagcctagcccggatcaggaggtgatccgcccttggcacagccccctgtatccccaagggcatctggccatcctcaaggggaatctggctcccgaaggagcagtagccaagattaccggcgtcaagaacccgcaaattaccgggccggcgcgggtcttcgattcagaggagtcctgcctgcaggccatcctctccggccagatccgagcaggggatgtggtggtgatccgctacgaaggccccaaaggtggccccggcatgcgggagatgctctcgcccacttcggccatcatcggcgccggcttgggggatagcgttggcctgatcaccgatggccgcttctccggcggcacctacggcatggtagtgggccatgtggctcccgaagcctatgtggggggcacgattgccctggtggaggaaggggatctcatcaccattgatgccccggctcgccagttgcacttgcatgtgagcgaagaagagctggcccgccgccgcgcccgctggtctcctcctgagcctcgctacaaacggggcaccctagccaagtacgccaagctggtctccagcagcagcctgggggcagtgacggatttaaacctgtgggattaa

SEQ ID NO: 304 - protein, 565 aa, Synechococcus sp.
MANSPFPLRSQVVTQGVQRSPNRAMLRAVGFRDEDFGKPIVGIANAHSTLTPCNMGIQTLAERAEAALRTAGCMPQVFGTITISDGISMGTEGMKYSLVSREVIADSIETVVNGQSMDGLLAIGGCDKNMPGAMIAMARLNVPSIFVYGGTIKPGHYNGRDLTIVSAFEAVGEFSAGRISEEELLAVERHACPGAGSCGGMYTANTMSSAFEAMGMSLPYSSTMAAEDEEKAESAAQSAKVLAEAIKANIRPRDIITRKSIENAISVIMAVGGSTNAVLHFLAIAHAAEVPLTLDDFETIRARVPVLCDLKPSGRFVATDLHRAGGIPQVMKMLLNHGLLHGDCLTISGQTIVEVLRDVPDEPSPDQEVIRPWHSPLYPQGHLAILKGNLAPEGAVAKITGVKNPQITGPARVFDSEESCLQAILSGQIRAGDVVVIRYEGPKGGPGMREMLSPTSAIIGAGLGDSVGLITDGRFSGGTYGMVVGHVAPEAYVGGTIALVEEGDLITIDAPARQLHLHVSEEELARRRARWSPPEPRYKRGTLAKYAKLVSSSSLGAVTDLNLWD

SEQ ID NO: 305 - DNA, 1683 bp, Gloeobacter violaceus
atgtccggcaatctgcgcagccgcatcgtcacccagggggtgcagcgctcccccaaccgcgccatgctgcgggcggtgggttttggcgacggtgatttcgagcggcccatcgtgggggtggccaacggcttcagcacgattaccccctgcaatctgggcctgggagctttggcggagcgggcggaggcggcgttgcgcgccggcggggcgatgccccaactattcggaacgatcacgatcagcgacggcatctcgatgggtaccgaggggatgaagtactcgctggtgtcccgcgaggtgatcgccgacagcatcgagacggtctgcaacggtcagagcctggacggggtgctcgctatcggcggctgcgacaagaacatgccgggtgcgatgatcgccattgccagactcaatatcccggcggtcttcgtctacggcggcacgatcaaacccggccgctaccaggatcaggacctcacggtcgtgagcgccttcgaagcggtgggccagtacagcgccggcaaaattgaccagacgaccctcgtcgaaatcgagcggcgcgcctgcccgggggcgggctcctgcggcggcatgtacaccgccaatacgatgagttcggccttcgaggcgatgggcatgagcttggtgtactcctcgacgatggccgccgaggatcccgaaaaagcggacagcaccgccctgtcggccaaggtgctggttgaagcgatccaagcgcaaatcctgccgagcgccatcctgacgcgaaaagctttcgagaacgccatcgctgtgatcatggccatcggcggctcgaccaacgccgtgctgcacctgcttgccatcgcccacagcgcccgggtgccactcgcactggatgacttcgagtgcatccgcgcgcgggtgccggtgctgtgcgatctcaagcccagcggtcgctttgtcgccaccgatctgcacagagccgggggtattccccaggtgatgaaaatgttgctcgtgcgcgggctcctccacggcgacgccctcacggtaaccggccagacggtcgccgaggtgctgcgcgacgtacccacagaaccgcgcaccgaccaggaggtgatccgtccctgggaccggcctctctacagttcggggcacctggccattttgcgcggcaacctggcgagcgaaggggcggtcgccaagattaccggcgtcaaaaagccccagatcactggtcctgcccgcgtcttcgactccgaagaaagctgcatggaagcaattctggcgggcgccatccagccgggcgatgtgatcgtcattcgctacgaaggccccaagggcggtcccggcatgcgggagatgctctcgcccacttcggccatcatcggcgcgggtctgggcgatgcggtgggactgatcaccgacggccgcttctcggggggcacctacggcatggtcgtgggccacgtcgccccggaagccttcgtgggcggcaccatcgccctggtcgaagcaggagatctgatcaccatcgacgccccggcgcgcaagatcgagctattggtgaccacagacgaactggagcgccgacgcgccgcctggcggccgcctgccccccgttacatccgcggggtgctcgccaagtacgcccgtcaggtgaacagcagcagcctcggggcggtcaccgacgcctttatttga

SEQ ID NO: 306 - protein, 560 aa, Gloeobacter violaceus
MSGNLRSRIVTQGVQRSPNRAMLRAVGFGDGDFERPIVGVANGFSTITPCNLGLGALAERAEAALRAGGAMPQLFGTITISDGISMGTEGMKYSLVSREVIADSIETVCNGQSLDGVLAIGGCDKNMPGAMIAIARLNIPAVFVYGGTIKPGRYQDQDLTVVSAFEAVGQYSAGKIDQTTLVEIERRACPGAGSCGGMYTANTMSSAFEAMGMSLVYSSTMAAEDPEKADSTALSAKVLVEAIQAQILPSAILTRKAFENAIAVIMAIGGSTNAVLHLLAIAHSARVPLALDDFECIRARVPVLCDLKPSGRFVATDLHRAGGIPQVMKMLLVRGLLHGDALTVTGQTVAEVLRDVPTEPRTDQEVIRPWDRPLYSSGHLAILRGNLASEGAVAKITGVKKPQITGPARVFDSEESCMEAILAGAIQPGDVIVIRYEGPKGGPGMREMLSPTSAIIGAGLGDAVGLITDGRFSGGTYGMVVGHVAPEAFVGGTIALVEAGDLITIDAPARKIELLVTTDELERRRAAWRPPAPRYIRGVLAKYARQVNSSSLGAVTDAFI

SEQ ID NO: 307 - DNA, 1674 bp, Nitrosomonas eutropha
atgccagacaatcgacgcagccaggccatcactaaaggtgcgaaacgtgctcccaatcgcgccatgttacgtgcagttggattcggtgacggagatttcgataagcccattgtcggcattgccaacggcttttccaccatcacgccttgcaacatggggctggatacgcttgccaaatgtgcggaacatgcattgaaaaatgccggtgccatgccgcaaatgttcggcacgattacggtatcggatggtatctccatgggcaccgaaggcatgaaatactcactggtatcacgcgaggtaatcgctgattccattgaaacctgcgtgcaggcggaaagcatggatggcgtcattgccattggcgggtgtgacaaaaacatgcctggtgccctaatcgcgctggctagactgaacgtgccatccatttttgtctatggcggcaccatcaagcccggtcactaccagggtcgcgatctgacaatcgtcagtgcgtttgaagcggttgggcaacatagcgcacacaagattgatgatcaggaactgctggaagttgaacgccatgcctgtcccggcgcaggttcgtgcggcggcatgtacaccgccaacaccatgtcctctgcgattgaggcgatgggcatgagtctgccccattcctccactatggctgcggaagatgaggaaaagcggatcagcgccacccgctctgccgaggtgctggtggaagcaatcaaaaaacagattctgccgcgcagcctgattacccgcaagtcactcgaaaatgcagtaacggtagtcatggccgtaggcggctcgaccaatgctgtgctgcatctgctggccatcgcccacgcagcagaagtagattttcatattgacgatttcgaagcgattcgtgcccgtgtgccggtgttgtgtgacctgaaaccttccgggcgctacgtcgccactgatctgcacagagcaggcggcattccacaagtgatgaaaatgctgctcgtgcacggtctgctgcatggtgactgtctgaccatcagcggacaaactatcgctgaagtactgaaagatattcctgaacaaccgcgcgcggatcaaaacgtcatccgcacctgggacaacccggtgtatgaacaaggtcatctggcgatcctgaagggtaatctttcgccggaaggtgcggtggccaagatttccggtgtaaaaaaccccaatattaccgggcccgccagagtgtttgaatccgaagaaacctgtatgactgccattctcgatcgcaaaatcaagccgggtgatgttgtcgttattcgctacgaggggccacgcggcggtcccggcatgcgtgaaatgctctcccctacttcggcgctaatcggtgaaggattgggtgattcggtcggattgattaccgatggccgtttttccggcggcacctacggcatggtcgtaggccatgtagcaccggaagcatacgccgggggagtgatcgctctggtggaagaaggagattcaatcacaatcgatgcgcatcgccgcctgttacaactgaatgtttcagaaacagaattggaacgccgccgggctgcctggcagccgcctgcgccgcgctacacacgcggtgtactggcaaaatatgccaaactggtatcaaccgccagtcgtggtgcggttactgattaa

SEQ ID NO: 308 - protein, 557 aa, Nitrosomonas eutropha
MPDNRRSQAITKGAKRAPNRAMLRAVGFGDGDFDKPIVGIANGFSTITPCNMGLDTLAKCAEHALKNAGAMPQMFGTITVSDGISMGTEGMKYSLVSREVIADSIETCVQAESMDGVIAIGGCDKNMPGALIALARLNVPSIFVYGGTIKPGHYQGRDLTIVSAFEAVGQHSAHKIDDQELLEVERHACPGAGSCGGMYTANTMSSAIEAMGMSLPHSSTMAAEDEEKRISATRSAEVLVEAIKKQILPRSLITRKSLENAVTVVMAVGGSTNAVLHLLAIAHAAEVDFHIDDFEAIRARVPVLCDLKPSGRYVATDLHRAGGIPQVMKMLLVHGLLHGDCLTISGQTIAEVLKDIPEQPRADQNVIRTWDNPVYEQGHLAILKGNLSPEGAVAKISGVKNPNITGPARVFESEETCMTAILDRKIKPGDVVVIRYEGPRGGPGMREMLSPTSALIGEGLGDSVGLITDGRFSGGTYGMVVGHVAPEAYAGGVIALVEEGDSITIDAHRRLLQLNVSETELERRRAAWQPPAPRYTRGVLAKYAKLVSTASRGAVTD

SEQ ID NO: 309 - DNA, 1674 bp, Nitrosomonas europaea
atgccagataatcgacgcagccaaaccattacccaaggtgcacaacgcacccccaaccgcgccatgttacgcgcagtcggtttcggtgacggagacttcgataaacctatcgtcggggttgccaacggtttttccaccatcacaccctgcaacatggggctggatacccttgccaaatgcgccgaacatgcgctgaaaaccgccggtgccatgccgcagatgtttggcaccatcaccgtatccgacgggatctccatgggtaccgaaggcatgaagtattctctggtttcgcgcgaagtgatcgccgattcgatcgaaacctgcgtacaggcggaaagtatggatggcgtcatcgccatcggtggttgcgataaaaacatgcctggcgccatgatcgcgctggccagactgaacgtaccgtccatcttcgtctatggcggtaccatcaaacctggccattaccagggccgtgatctgaccatcgtaagcgctttcgaagctgtcggacagcataccgcgcacaagatagacgatcatgaactgctggaagtcgaacgccatgcctgtcccggcgccggttcgtgcggtggtatgtacacagccaacaccatgtcatctgccatcgaggcaatgggaatgagcctgccttactcttccaccatggcagcagaagatgaggaaaaacggatcagcgccatacgctccgccgaagtactggtggacgcggtcaaaaagcagattctgccgcgcagcctgatcacccgcaaatccatcgaaaatgcggtatctgtcgtcatggcggtgggaggttcgaccaatgccgtgctgcacctgctggccatcgcccatgcagccgaagtggaattcagcatcgatgatttcgaagccattcgtgcacgcgtaccggtattgtgcgatctgaaaccttccggacgctatgtagccacggatctgcacaaagcgggcggtattccgcaagtgatgaaaatgttgctggtacacgacctgctgcacggcgactgtctgaccatcagcggacaaaccatcgcggaagtgctgaaagacattcccgaacagccgcgtgccgatcaggatgtgattcaaccctgggacaatccggtatatgaacaggggcacctggcgatcctgaaaggtaatctttcatcagaaggtgcggttgccaagatttccggcatcaaaaatcccagtattaccggtcccgccagagtgttcgattctgaagaaacctgcatggctgccattcttgaacgcaaaatccagccaggtgatgtggtggtcatccgctacgaaggcccacagggcggacccggcatgcgcgaaatgctttctcccacttcagcactgatcggtgaagggctgggtgattcggtcgggttgattaccgatgggcgtttctccggtggtacctacggaatggtggtgggccatgtggcaccggaagcattcgccggcggaacgatcgccctggtacaagagggagattcgattacgatcgatgcacaccgtcgcctgctgcaactgaatgttcctgaagccgagctggaacgccgccgggcagcctggcatccacctgcaccacgctacacacgcggcgtactggcgaaatacgccaagctggtatccactgccagccgtggtgcagtcaccgattaa

SEQ ID NO: 310 - protein, 557 aa, Nitrosomonas europaea
MPDNRRSQTITQGAQRTPNRAMLRAVGFGDGDFDKPIVGVANGFSTITPCNMGLDTLAKCAEHALKTAGAMPQMFGTITVSDGISMGTEGMKYSLVSREVIADSIETCVQAESMDGVIAIGGCDKNMPGAMIALARLNVPSIFVYGGTIKPGHYQGRDLTIVSAFEAVGQHTAHKIDDHELLEVERHACPGAGSCGGMYTANTMSSAIEAMGMSLPYSSTMAAEDEEKRISAIRSAEVLVDAVKKQILPRSLITRKSIENAVSVVMAVGGSTNAVLHLLAIAHAAEVEFSIDDFEAIRARVPVLCDLKPSGRYVATDLHKAGGIPQVMKMLLVHDLLHGDCLTISGQTIAEVLKDIPEQPRADQDVIQPWDNPVYEQGHLAILKGNLSSEGAVAKISGIKNPSITGPARVFDSEETCMAAILERKIQPGDVVVIRYEGPQGGPGMREMLSPTSALIGEGLGDSVGLITDGRFSGGTYGMVVGHVAPEAFAGGTIALVQEGDSITIDAHRRLLQLNVPEAELERRRAAWHPPAPRYTRGVLAKYAKLVSTASRGAVTD

SEQ ID NO: 311 - DNA, 1674 bp, Nitrosospira multiformis
atgtcagataaccagcgcagccgggcaatcacccagggggcggaacgtacccccaaccgcgcgatgctgcgggccgtaggtttcagcgacaacgatttcgacaaaccaatcgtcggcgtggccaatggcttttccaccatcacaccctgcaacaagggattgaacgaactggcgctggctgccgagcaggcattgaaacaggcggctgcgatgccccagatgttcggtaccatcaccgtttccgatggcatctccatgggaacggagggcatgaagtattcactggtatcccgcgaagtcattgccgactcgatcgaaacggcggtgcaggccgaaagcatggatggcgtgatcgccatcgggggctgtgacaagaacatgccaggagcaatgatcgccattgcgcgcatgaatgttcccgcaatttttgtttatggcggaacgattaaaccgggccactataaaggaaaggatctcactattgtcagcgcattcgaagccgtcggacaatatacctcccacaagatagacgcgaaagaactgctcgaagtggagcgccacgcctgtccgggagccggctcctgcggaggcatgttcactgccaatacgatgtcgtccgctttcgaagcgatgggcatgagtctcccctattcttccacgatggccgcggaggatggcgagaagctaaccagcgcggcgcgctccgcggaagtgctcgtggatgccatcaggaaacagattcgcccgcgcgacatcattacccgcaagtccattgaaaacgcgatcgcggtgatcatggccgtgggtggttccaccaatgctgttttgcacttcctcgccattgcccatgcggccgaagtgacactcaccatcgatgattttgaacgcatgcgcggcaaagtgccggtactgtgcgatctcaaaccttcgggacggtacgttgccaccgacctgcacaaggcagggggcattccccaggtcatgaaaatgctgctcgaccacggcctgttgcatggcgactgcatcaccatcagcggacagaccattgccgagatattgaaggatgtgccgtcagagcctcgcgaagatcaggatgtcattcgccagtgggacaacccgttgtacgtccagggccacctcgccatactcaagggcaatctcgccccagaagggtgcgtggcgaaaatcaccggggtgaaatccccaaaaattaccggaccggcacgcgtattcgattcggaagaagcctgcatggcagctatccttgcgcgggagatccagcccggcgacgtggtggtgatacgctatgagggacccaagggcggccccggcatgcgggaaatgctgtctcccacttccgcgcttattggcgagggactcggagattcggtgggcctgatcaccgatggacgattctccgggggcacctatggaatggtggttggacacgtggcgccggaggcgttcgtaggcgggaccattgcgctggtgcgagaaggcgattcgattaccatagacgccgagcaacggctgctgcagctcaacattcccggagatgagctggctcggcgccgggctgaatggcaaccgccccatccgcgctacacccggggagtgctcgctaaatattcgaagctcgtctcgagtgccagccgcggcgcaatcaccgactag

SEQ ID NO: 312 - protein, 557 aa, Nitrosospira multiformis
MSDNQRSRAITQGAERTPNRAMLRAVGFSDNDFDKPIVGVANGFSTITPCNKGLNELALAAEQALKQAAAMPQMFGTITVSDGISMGTEGMKYSLVSREVIADSIETAVQAESMDGVIAIGGCDKNMPGAMIAIARMNVPAIFVYGGTIKPGHYKGKDLTIVSAFEAVGQYTSHKIDAKELLEVERHACPGAGSCGGMFTANTMSSAFEAMGMSLPYSSTMAAEDGEKLTSAARSAEVLVDAIRKQIRPRDIITRKSIENAIAVIMAVGGSTNAVLHFLAIAHAAEVTLTIDDFERMRGKVPVLCDLKPSGRYVATDLHKAGGIPQVMKMLLDHGLLHGDCITISGQTIAEILKDVPSEPREDQDVIRQWDNPLYVQGHLAILKGNLAPEGCVAKITGVKSPKITGPARVFDSEEACMAAILAREIQPGDVVVIRYEGPKGGPGMREMLSPTSALIGEGLGDSVGLITDGRFSGGTYGMVVGHVAPEAFVGGTIALVREGDSITIDAEQRLLQLNIPGDELARRRAEWQPPHPRYTRGVLAKYSKLVSSASRGAITD

SEQ ID NO: 313 - DNA, 1695 bp, Chloroflexus aggregans
atgagcgataatcgccgtagtcgtatgattaccgaaggcccacagcgttcacccaatcgggcaatgctgcgcgcggtcgggtttggcgacaacgattttacgaagccgatcgtgggagtggctaacggtcacagtacgctgacaccgtgcaacgccggcttaggggcgttggcagcgcgggcggaagccgctattcgtgccgcaggaggtatgccgcagatcttcggcacgatcacggtcagcgatggtatctcgatggggactgaagggatgaagtattctttggtcagccgcgaggtgattgccgattcgattgagacggtcgtcaacgcacagcggatggacggaatccttgcggtgggtggctgcgataagaacatgcccggcgccttaattgccatggcccggctcgacattccggccatctttgtctatggtggtactatcaaacccggtcattacaaaggccgtgacttgaccatcgtcagcgtgtttgaggcagttggcgaatacagtgccggtcggatcgacgaacacgagttgctcgaaatcgagcgtcacgcatgccccggcgtcggttcgtgtggtggtatgtacactgccaatacgatgtcgtcggcaattgaagcgctgggcttgagtttacccggctcttcaaccatggctgccgaagacgaggaaaaggcgatcagcgcagctcgttccggcgaggtgttagttgaggccatccgcgccaatcgcacagcgcgccagatgttgacccgcaagtcgtttgagaatgcgattgcagtagtgatggcgttaggtggctcgaccaacgccgttttgcatctgctggcgattgcctatgctgccaacgtaccgttgaccatcgatgattttgagacgatccgccagcgggtaccggtgctctgcgatctcaagccatcgggccgctatgtggcgaccgatctccaccgtgtcggtggtgtaccgcaggtgatgaagatgttgttgaatgccggcttactccacggtgattgtatgacgattaccggacagacaatcgctgaggtgctggccgatgtacccgacgagccgccggccgatcaagatgtcatccgcccctttcataaacccctctatccgcaaggacatttggccatcctccgtggtaatctggccgaagaaggctgcgttgcgaagattaccggtattaagcagcgctcgattaccggaccggcccgtgttttcgatgccgaagaggaatgtctcgaagcgattttgagtggcaagattaagccgggcgatgtcgtggtgatccggtacgaagggccgaagggtggtcccggtatgcgtgaaatgctcgctccgacatcggcgattatcggtgccggtttgggcgatagcgttggcctgattaccgacggacgcttctctggtggtacgtatggcttggtggtcggtcatgttgcccctgaagcggcggttggtggcaccattgccctggtcgaagagggtgatagtatcacgattgacgccgatgcccgtctcttgcagctcaatgtctcggacgaagagttggcacgacgccgtgctgcgtggcaaccccgtccgccacgctatacccgtggtgtattggcgaagtatgccaggctggtgtcgtcggctagccttggtgcagtgaccgaccgcttcgatggcgagtcggcgtaa

SEQ ID NO: 314 - protein, 564 aa, Chloroflexus aggregans
MSDNRRSRMITEGPQRSPNRAMLRAVGFGDNDFTKPIVGVANGHSTLTPCNAGLGALAARAEAAIRAAGGMPQIFGTITVSDGISMGTEGMKYSLVSREVIADSIETVVNAQRMDGILAVGGCDKNMPGALIAMARLDIPAIFVYGGTIKPGHYKGRDLTIVSVFEAVGEYSAGRIDEHELLEIERHACPGVGSCGGMYTANTMSSAIEALGLSLPGSSTMAAEDEEKAISAARSGEVLVEAIRANRTARQMLTRKSFENAIAVVMALGGSTNAVLHLLAIAYAANVPLTIDDFETIRQRVPVLCDLKPSGRYVATDLHRVGGVPQVMKMLLNAGLLHGDCMTITGQTIAEVLADVPDEPPADQDVIRPFHKPLYPQGHLAILRGNLAEEGCVAKITGIKQRSITGPARVFDAEEECLEAILSGKIKPGDVVVIRYEGPKGGPGMREMLAPTSAIIGAGLGDSVGLITDGRFSGGTYGLVVGHVAPEAAVGGTIALVEEGDSITIDADARLLQLNVSDEELARRRAAWQPRPPRYTRGVLAKYARLVSSASLGAVTDRFDGESA

SEQ ID NO: 315 - DNA, 1674 bp, Leptospirillum sp.
atgaaaaagccatttcgaagccggaccatcacccagggagtggaaagatctcccaacagggccatgctccgggccgtcgggttccaggatggggattttgaaaaaccgattatcggagtggcgaatggctacagcaccattacaccctgcaacatgggcctgaacagtctggctcttcgtgccgaggacgccattcgccagagaggagccatgccccagatgttcggaaccatcacggtttcggacggaatatcgatgggaacggaaggaatgaagttttccctggtgtcccgggaagtcatcgccgactccatcgaaacggcggtcagcgcccaaagcatggacggcgtgatcgccatcggggggtgcgacaagaacatgccgggagccctgatcgccatggggcgcatgaacatcccctccatttttgtttatggaggaaccatcaagcccggccactgggaaggtcaggacctgacggtcgtgagctcgttcgaagcggtcggggcctactcggcaggcaagatggacgaggcaaccctgaccgaaatcgagcgtcatgcctgtccgggagccggatcctgtggcggcatgttcactgccaataccatgtcgtcggcgatcgaagccatggggatgagtttgccctattcctccaccatggcagcggaagaccttgaaaaagccgaaagcgcagccgaatccgcaagagttcttgtccaggcggttctgaacgacctgcgtcctcgacagatcctgaccagaaaggcctttgaaaacgccattgcagtcctgatggccgttggaggctcgacgaacgcggttcttcacctcctcgcgatcgcccgctccgtcgacgtccccctttccatagacgactttgaacacattcgacgaaaggtccctgtcctttgcaacctcaagccctccggggcctatgtcgccacacagcttcacgctgtcgggggcattcccctcgtcatgcgcatgctgctggacaacggactccttcatggcgacgcgctgaccattacagggaagacgatttccgagacgctccgggacgttccttcccgtcccccggccggacaggatgtcgtgctcccctttgacaaacccgtttaccgggagggccaccttgcgatcctgaagggaaatctcgccccggaaggatcggtcgcaaagatctcgggcatcaaacaccgttccattaccggcccggcccgggtcttcgactccgaagaacgctgcatggcagccatcctggcccgggaaattcgtcccggagacatcgtcgtgatccggtacgaaggccccaaaggcggtcccggaatgcgggaaatgctggccccgacctccgccctgatcggagaaggtctcggggactcggtcggcctgattacagatggacgtttttccgggggcacatacggcatggtggtgggtcacgtctcgccggaagcggctgtgggcgggccgatcggactggtgcaggaaggagacctcattacgatcgacgccgaccggaatctgatcgaggtcaaggtttcaccggacgaaatgacaagaagaaaatctctgtggaaggaaccccctctccgatacacaaaaggaatcatggccaaataccgtcttctcgtcaaaagtgccagcgaaggcgccgtgacagactga

SEQ ID NO: 316 - protein, 557 aa, Leptospirillum sp.
MKKPFRSRTITQGVERSPNRAMLRAVGFQDGDFEKPIIGVANGYSTITPCNMGLNSLALRAEDAIRQRGAMPQMFGTITVSDGISMGTEGMKFSLVSREVIADSIETAVSAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDNGLLHGDALTITGKTISETLRDVPSRPPAGQDVVLPFDKPVYREGHLAILKGNLAPEGSVAKISGIKHRSITGPARVFDSEERCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSPDEMTRRKSLWKEPPLRYTKGIMAKYRLLVKSASEGAVTD

SEQ ID NO: 317 - DNA, 1677 bp, Leptospirillum sp.
atgaaagacaaccggagaagtcgtgtcacgaccgaaggcgtggagcgctctcccaaccgggccctgcttcgggccacggggttccgggacgacgattttggcaagccgattgtcggggtggcgaacgcccacagttccatcaccccctgcaatatggggatcgggaaactcgcttcgcgggcggaagaagctctccgcaaggccggctccatgccccagaccttcgggaccatcacggtgtcggacggaatctcgatgggcaccgaaggcatgaaatattccctcgtctcgagggaagtgattgccgattcgatcgaaacggtcgtgaacgcgcagagcatggacggccttctggcgttcgggggatgcgacaaaaacatgccgggggcactgatcgcgatgggccgtctcgacattccctccgtcttcgtctacggagggacgattcgtccgggacaccacaacggacaggacctgaccgtcgtcagcgccttcgaggccgtcggggaatatctcgcgaaccggatcgaccgggaagaacttctggcaatcgaacgccacgcctgtcccggagccggatcctgcggcgggatgtttaccgccaacaccatggcagccctgatcgaaaccatgggcatgagcctcccctattcctccacgatggccgccgaagacgcggaaaaatcggaaaacgcggaagagtccgcgaagatcctggtcaacgccatccggaaccagatccgtccccgccagattctgacgcggcatgccttcgaaaatgcgatcgcggtcacgatggccatcggagggacgaccaacgccgttctgcatctccttgccatcgcccgggcggtcgaggttccgctttcgatcgacgacttcgccgcaatccgggaacgggtccctgttctgtgcgatctcaagccatgggggcggtatgtggcaaccgaccttcaccgggcgggagggattccccaggtcatgaaaatcctgttgtcgaacggactgttgcatggggaagccctttccgtcaccggccggaccatcgcggaactgctggaaaacatcccggaagaccccccgaaagaagatcaggatgtgattcgtccgtttcgcgcgccggtcctcgaacgggggcatatcgccatcctccggggaaacctcgcccccgacggatcggtggccaaagtgacggcctcccgtcctgtggcattcacgggaccggcccgtgtcttcgattcggaagaagacggcatgaaggccattctggcaagagagatccgtccgggagatgtcgtagtcatccgttacgagggtcccgtgggaggaccgggcatgcgggaaatgctcgcaccgaccgccgcccttgtcggggaaggcctgggggagagcgtggcgctggtcacggatggacggttctccggaggaacccgggggatggtcgtgggtcatgttgcacccgaagcggccgtgggaggaccgatcgccctggttgccgacggcgatccggtcacggtcgaccccggacggagctgtctccggctcgatgtgccggaggaggaatttctccgccggcaggccgcatggcgtccccgtccgccccgcaccctccggggggttctggcgaagtacgcccggcaggtctcttcggccagcgaaggcgccgtcaccgactga

SEQ ID NO: 318 - protein, 558 aa, Leptospirillum sp.
MKDNRRSRVTTEGVERSPNRALLRATGFRDDDFGKPIVGVANAHSSITPCNMGIGKLASRAEEALRKAGSMPQTFGTITVSDGISMGTEGMKYSLVSREVIADSIETVVNAQSMDGLLAFGGCDKNMPGALIAMGRLDIPSVFVYGGTIRPGHHNGQDLTVVSAFEAVGEYLANRIDREELLAIERHACPGAGSCGGMFTANTMAALIETMGMSLPYSSTMAAEDAEKSENAEESAKILVNAIRNQIRPRQILTRHAFENAIAVTMAIGGTTNAVLHLLAIARAVEVPLSIDDFAAIRERVPVLCDLKPWGRYVATDLHRAGGIPQVMKILLSNGLLHGEALSVTGRTIAELLENIPEDPPKEDQDVIRPFRAPVLERGHIAILRGNLAPDGSVAKVTASRPVAFTGPARVFDSEEDGMKAILAREIRPGDVVVIRYEGPVGGPGMREMLAPTAALVGEGLGESVALVTDGRFSGGTRGMVVGHVAPEAAVGGPIALVADGDPVTVDPGRSCLRLDVPEEEFLRRQAAWRPRPPRTLRGVLAKYARQVSSASEGAVTD

SEQ ID NO: 319 - DNA, 1698 bp, Halorhodospira halophila
atggcggataaccgtcgcagccgagtgatcacccagggcgtggcccgaacccccaaccgcgcgatgctgcgcgccgtcggtttccgggatgaggatttcgagaagccgatcatcggggtcggcaacgcgcacagtacgatcaccccctgcaacgtcgggatcggcgccatggcgcggcgcgccgaggaggcgctgcgcgaggtgggggcgatgccgatgaagttcggcaccatcaccgtctccgacgggatcaccatgggcaccgagggcatgaagtactccctggtctcccgcgaggtgatcgccgattcgatcgagacggtgggcggtggccagcggatggacggcatgctcgccactggtggctgcgacaagaacatgcccggggcgatgatggccctggcccgtctggatatcccgggtatcttcgtctatggcggcaccatcaagccgggtcattacaagggcgaggatctcaccgtggtcagcgccttcgaggcggtggggcagtacaacgccggcaacctctccgaggccgatctcaagggggtcgaggagaacgcctgccccggggcgggcgcctgtggcggcatgttcacggccaacaccatgtccagcgccttcgaggccatgggcatgagcctgatgggctcgtccaccgtctctgccgaggacgacgaggcccgggatgtggccgccgaggcgtcccgggtcctgatggacgctgtccatcacgaccggcgcccgtcctcgatcctcacccgcgaggccttcgagaacgcctttgcggtggtgatggccctgggcggctccactaacgccgtgctccacctgctggccatcgccaataccgccgaggtgccgttcgacctcgacgacgtcgagcgcatccgccgcaaggtgccggtactctgcgacctcaagccgtcgggccggttcgtgaccagtcagttccacgaggtcggcggcacgccgcaggtgatgcgcatcctcctggagcaggggctgttgcacggccactgccagaccatcaccgggcagaccatcgaggccctcatcggccacctgccgccggagccgccggcggatcaggagatcatcatgcccttcgatcggccgctctatcccgagggtcacctggcaatcctgcggggcaacctggctgaagagggtgccgtggccaaggtcagtggcatccaacagcgccgtatcagcggaccggcccgcgtgttcgattccgaggaggagtgcctggaggccatcctggccgacggggtgcaggccggtgacgtggtgatcgtccgctacgaggggcccaagggagggcccggcatgcgcgagatgctggcgcccacctcggcgatcatcggcaaggggctcggcgatgcggtggggctgatcactgacggccgtttctccggcgggacctacgggatggtggtcgggcacgtggcgcctgaggcctacgacggcgggaccatcgcgctgattgccgagggcgatacggtgaccatcgacgccgaccagaacctgcttcaggtggaggtggatgacgcggagctcgagcgtcgccgcagccagtggcaggtgccccggcctcgctaccgtcgcggggtgttgggcaagtatgcgcgcctggcggcctcggccagtcgcggtgcagtgaccgacgccgacctcttccccgagcaggagtag

SEQ ID NO: 320 - protein, 565 aa, Halorhodospira halophila
MADNRRSRVITQGVARTPNRAMLRAVGFRDEDFEKPIIGVGNAHSTITPCNVGIGAMARRAEEALREVGAMPMKFGTITVSDGITMGTEGMKYSLVSREVIADSIETVGGGQRMDGMLATGGCDKNMPGAMMALARLDIPGIFVYGGTIKPGHYKGEDLTVVSAFEAVGQYNAGNLSEADLKGVEENACPGAGACGGMFTANTMSSAFEAMGMSLMGSSTVSAEDDEARDVAAEASRVLMDAVHHDRRPSSILTREAFENAFAVVMALGGSTNAVLHLLAIANTAEVPFDLDDVERIRRKVPVLCDLKPSGRFVTSQFHEVGGTPQVMRILLEQGLLHGHCQTITGQTIEALIGHLPPEPPADQEIIMPFDRPLYPEGHLAILRGNLAEEGAVAKVSGIQQRRISGPARVFDSEEECLEAILADGVQAGDVVIVRYEGPKGGPGMREMLAPTSAIIGKGLGDAVGLITDGRFSGGTYGMVVGHVAPEAYDGGTIALIAEGDTVTIDADQNLLQVEVDDAELERRRSQWQVPRPRYRRGVLGKYARLAASASRGAVTDADLFPEQE

SEQ ID NO: 321 - DNA, 1689 bp, Nitrococcus mobilis
atggccgataatcgccgcagccgcgtgatcacctacggtgtggcccgtacgcctaatcgggccatgctgcgcgctgtcggttttaccgacactgatttcgataaaccgatcgttggagtgggcaatgcccacagcaccatcacaccctgtaatgtgggcatcggtgcattagcggctcaggccgaacaggcgctgcgtgaagccggtgccatgccggtcagctttggcaccatcactatttctgatggtatatccatgggcacggaggggatgaagtactcgctggtctcgcgcgaggtcatagccgatgccatcgaaacggtaggcaacggccagtgcctggatggcatgctcgccaccggtggttgcgacaagaacatgccgggcgccatgattgccatagcacgcatgaatattccggcgatcttcgtttatggcggcaccatcaagccgggtcgctataagggtcaggatctgaccatcgtcagcgctttcgaggcggttggacagtatgccgccggcaaactctcagtcgaggatttgcagggcgtggaacgcaacgcttgccccggtgccggtgcctgcggcgggatgtacacggctaataccatgtccagcgccttcgaggccttgggtatgagcctgatgggctcctccaccctgtgcgcggaggatccggagaaagtgcagagtgcgcggcgctcggctcaagtcctggtagacgccatccaggaacagcgtttaccgcgtgccataatgacccgccaggcgttcgaaaacgcctttgcggtggtcatggcgctcggcggatcgaccaatgccgtgctgcatttgttggcgatcgccaacgctgcggaggtcgattttagcattgacgatgtcgaaaccatccgccgccaggtgcccgtgctctgcgagctcaagccctccgggcgcttcgtaaccagccagtttcatgaggtcggcggtactccgcaggtcatgaagatccttttggcccacggcttattgcacggcgcttgccttactgtttccgggcattctattgctgaattgttggccgacataccggccgagccgccgagcgaccaggatatcattcggcctttcaagcagccgctgtacccgcagggacatctcgccatcctgcgcggcaatctggcggaggagggtgccgtcgccaaggtcaccggcatcaaacagcgccggatcacaggtccggcacgggttttcgactccgaagagggtgccctggaggcgattctggcggatcaaatcgtggcgggtgacatcgtcgtgattcgttatgagggcccgaagggtgggccgggcatgcgcgagatgctggcgccgacctcggcgatcatcggtaaaggtttgggtgatgcggtaggtcttattaccgacgggcgcttctccggtggtacctatgggatggtggtcggtcatgttgcaccagaggcggcagtcggcggtacgattgccttggtgcgggagggtgatgaaatcacgatcgatgccgatcgcaatctgctgatgctccatgtcgccgacacggaaattgtccagcgccgagccgcctggcagccgccacggcctatttatcgtcgcggtgtgctcgcgaagtacgccaagttggtctcctcggcgagcattggagcggttacggacaaagatctattcgactga

SEQ ID NO: 322 - protein, 562 aa, Nitrococcus mobilis
MADNRRSRVITYGVARTPNRAMLRAVGFTDTDFDKPIVGVGNAHSTITPCNVGIGALAAQAEQALREAGAMPVSFGTITISDGISMGTEGMKYSLVSREVIADAIETVGNGQCLDGMLATGGCDKNMPGAMIAIARMNIPAIFVYGGTIKPGRYKGQDLTIVSAFEAVGQYAAGKLSVEDLQGVERNACPGAGACGGMYTANTMSSAFEALGMSLMGSSTLCAEDPEKVQSARRSAQVLVDAIQEQRLPRAIMTRQAFENAFAVVMALGGSTNAVLHLLAIANAAEVDFSIDDVETIRRQVPVLCELKPSGRFVTSQFHEVGGTPQVMKILLAHGLLHGACLTVSGHSIAELLADIPAEPPSDQDIIRPFKQPLYPQGHLAILRGNLAEEGAVAKVTGIKQRRITGPARVFDSEEGALEAILADQIVAGDIVVIRYEGPKGGPGMREMLAPTSAIIGKGLGDAVGLITDGRFSGGTYGMVVGHVAPEAAVGGTIALVREGDEITIDADRNLLMLHVADTEIVQRRAAWQPPRPIYRRGVLAKYAKLVSSASIGAVTDKDLFD

SEQ ID NO: 323 - DNA, 1692 bp, Alkalilimnicola ehrlichei
atgagtgagaaccgccgcagtcgggtcgtgaccgcaggcctgcgccgcacccccaaccgggccatgctgcgcgccaccggcttccgggacgaggacttcgacaagcccatcatcggcgtcgccaacgcccacagcaccatcaccccctgcaacatgcatatcgccgcgctcacccggcgggcggtggaggcgttgcaggcggccggtgccatggcaccggaatttggcgtgcccaccgtctcggacggcatcgccatgggcacgccggggatgcgctactcgctggtctcgcgcgaggtgatcgccgacgccatcgagacggtgtgcgagggccagagcctggacggcgtgctggccaccggcggctgcgacaagaacatgcccggggctatgatcgccatcgcgcgcatgaacataccggccctgtttgtctacggcggcaccatccgccccggctactacaagggcgagcggctggacatcgtctcggcgttcgaggcggtgggccaggcctccgcgggcaggatgagtgacgaggacctgcttggggtggagcgcaacgcctgccccggcgccggctcctgtggcgggatgtacaccgccaacaccatgtccagcgccttcgaggccatgggcatgagcctgcccgccagctccaccgtggccgccgaggcggaggagaagggcgacgacgtggcggccgccgcgcgggtgctgatggaggcggtgcgggcggatcgcaagccccgcgacatcctcacccgcgaggccttcgagaacggcttcgccctggtgatggccgtgggcgggtccaccaacgcggtgctgcacttgctggccatcgccgatgcggccgatgtgccgttgtcgctggacgacgtggagcgtatccggcagcaggtgcccgtgctctgcgatctgcggccctcgggccgctacgtgaccactgaatttcacgaggtgggcggcacgccgcaagtgctgcgcctgctgctggacgcgggcctgctccacggcgactgcctcactattaccgggcagacgcttgccgagaccctggccgacgtgcccccgacccccgcgaaggatcaggacatcatccggaccctggacaaccccctctacccggtgggccatctggccatcctgcgtggaaacctggcagaggagggggccgtggccaaggtgtccggccttaagcagcgccgcatcgtcggaccggcgcgggtattcgagggtgaggaggactgcctggaggcgatcctggccggccagattaagcccggcgacgtggtggtcatccgccacgaggggccgaagggcgggcccggcatgcgcgagatgctctcgcccaccgcggcgttgatgggggccgggctgggggagagcgtcggcctgatcaccgatgggcgcttctccggtggcacccgggggctggtggtgggccacgtggcgccggaggccgcagcgggtggcaccatcgccctggtccgggaaggcgacaccgtcaccatcgatgcggacgccaaccggctcaccctggaggtggacgaggcggagctcgcccgccggcgtgcggcctggcagccgccggaaccgagagcgacccggggcgtattgggcaagtacgcgcagatggtcggctcggcggcgcagggtgcggtcaccgatcgctggagcggcggcgcgtga

SEQ ID NO: 324 - protein, 563 aa, Alkalilimnicola ehrlichei
MSENRRSRVVTAGLRRTPNRAMLRATGFRDEDFDKPIIGVANAHSTITPCNMHIAALTRRAVEALQAAGAMAPEFGVPTVSDGIAMGTPGMRYSLVSREVIADAIETVCEGQSLDGVLATGGCDKNMPGAMIAIARMNIPALFVYGGTIRPGYYKGERLDIVSAFEAVGQASAGRMSDEDLLGVERNACPGAGSCGGMYTANTMSSAFEAMGMSLPASSTVAAEAEEKGDDVAAAARVLMEAVRADRKPRDILTREAFENGFALVMAVGGSTNAVLHLLAIADAADVPLSLDDVERIRQQVPVLCDLRPSGRYVTTEFHEVGGTPQVLRLLLDAGLLHGDCLTITGQTLAETLADVPPTPAKDQDIIRTLDNPLYPVGHLAILRGNLAEEGAVAKVSGLKQRRIVGPARVFEGEEDCLEAILAGQIKPGDVVVIRHEGPKGGPGMREMLSPTAALMGAGLGESVGLITDGRFSGGTRGLVVGHVAPEAAAGGTIALVREGDTVTIDADANRLTLEVDEAELARRRAAWQPPEPRATRGVLGKYAQMVGSAAQGAVTDRWSGGA

SEQ ID NO: 325 - DNA, 1695 bp, Deinococcus geothermalis
atgacggacacccgcaccaagcgcagaatgaactggaacagtcaccacatcacgcagggtgacgagcgggcgcccaaccgcgcgatgctgcgggcggtgggcttcgaagacggcgacttcgacaaggcgatcatcggggtggcgcacgcccagagcaacatcacgccctgtaacaacgggctgggcgaactcgccgaccacatcaccggtgcgcttcgcgagggcggagcgatgccgcaggtgtacggcaccatcacggtgtctgacggcatcagcatgggcaccgagggcatgaagtgctctcttgtcagccgggaagtgatcgcagactccatcgaaaccgtctcgcgtgggcaatcgcacgacggcctgattgtggtgggcggctgcgacaagaatatgcccggcgcaatgatcggcatcgcccggttgaatattcccgcgatcttcgtgtacggcgggaccatcaaaccggggcactatcagggcaaagacctcaccatcgtttcggtcttcgaggcggtgggggcctacggcgcgggcaagatgagccgcgaggacttcgagcagatcgagaaacgcgcctgtcccggcaacggttcctgtggcggcatgtacaccgccaacaccatgagcagtgccttcgaggcgatgggcatgagcctgccctattcgtccaccatgagtgccgtggacgccgaaaaggccgtttcggctgcggacagcgcccgcgccctgatccggttgatcgagcaggacatccgcccgctggacatcctgacgaaaaaagcctttgagaacgccatcacggtggtcatggcggtgggcggctcgaccaacgccgtgctgcacctgatggcgattgcccacgcctgcggtgttgacctcacgctggaagacttcgagcgcattcgcgagcgcacgccggtcttctgtgaccttaagcccagtggaaagtacgtcgccacggatctgcacgaggtcggcggcattccgcgcgtgatgaagatgctgctcaaagcgggcttgctgcacggcgactgcctgacagtgaccggacagacggtggccgagaacctggcggacgtgcccgaccagcccgaccccggccaggacgtcattctgcccttcgatcagccgctctactcgcaggggcacctcgccatcttgcggggcaacctggccccggaaggcagtgtcgccaagatcagcggcctgcggcagatcaagatcaccggtcccgcccgcgtctttgattcggaagaagagtgcatggcggcgatcatgggcgatcagatcaaggccggtgacgtgatcgtgattcgctacgaaggccctaagggcggccccggcatgcgcgagatgctctcgcccaccagcgcgatcatcggcaaaggcctgggcgacagcgtggggctgatcacagacggacgcttcagcggcggcacctacggcctggtggttggccacgtcgcgcccgaagcctatgtaggcggccccatcgcgctggtgcaggaaggcgacatcatcgagctgaacgccgaaacctgcgagctgacgctgcatgtggacgacgcagaactggagcgccgccgcgccgcgtgggtggccccggaaccgcgctaccggcggggcgtcctggcaaagtacgcgcgactagtaggcagtgcggcgcggggagcggtgaccgattag

SEQ ID NO: 326 - protein, 564 aa, Deinococcus geothermalis
MTDTRTKRRMNWNSHHITQGDERAPNRAMLRAVGFEDGDFDKAIIGVAHAQSNITPCNNGLGELADHITGALREGGAMPQVYGTITVSDGISMGTEGMKCSLVSREVIADSIETVSRGQSHDGLIVVGGCDKNMPGAMIGIARLNIPAIFVYGGTIKPGHYQGKDLTIVSVFEAVGAYGAGKMSREDFEQIEKRACPGNGSCGGMYTANTMSSAFEAMGMSLPYSSTMSAVDAEKAVSAADSARALIRLIEQDIRPLDILTKKAFENAITVVMAVGGSTNAVLHLMAIAHACGVDLTLEDFERIRERTPVFCDLKPSGKYVATDLHEVGGIPRVMKMLLKAGLLHGDCLTVTGQTVAENLADVPDQPDPGQDVILPFDQPLYSQGHLAILRGNLAPEGSVAKISGLRQIKITGPARVFDSEEECMAAIMGDQIKAGDVIVIRYEGPKGGPGMREMLSPTSAIIGKGLGDSVGLITDGRFSGGTYGLVVGHVAPEAYVGGPIALVQEGDIIELNAETCELTLHVDDAELERRRAAWVAPEPRYRRGVLAKYARLVGSAARGAVTD

SEQ ID NO: 327 - DNA, 1695 bp, Polynucleobacter sp.
atgaaacgcctcaatgaacgctctcgcatggttaccgagggggtcgctcgcgcacccaatcgttcgatgtactacgcgatgggttacgaagaaaaggatttcgtaaaaccaatggttggcgttgcaaacggccactccactattaccccttgcaatagtggcttacaaaaattagctgatgccgcagttgaagctctagaagcagctggcgcaaaagcacaagtatttggtacgccaaccgtttctgatggtattggtatgggtactgagggtatgaagtattccctcgtctcacgagaagtgattgctgacagtattgaagtttgtgtaaacggtctttggcaagatggcgtagtagtcattggtggctgcgataaaaatatgcctggtggcatgatggctttagctcgcacgaatgtacctggcatctatgtatatggtggcacgattaagccaggccactttaaaggcaaggaattgaatattgtttctgcatttgaagcagttggtgaatttacctccggtcgattgagtgaagaagatttaaaaggtgttgagcaacacgcctgcccaggtagcggctcttgcggtggaatgtacacggccaataccatgagctcttcatttgaggctttgggtatgagcttgccctactcttctacgatggcaaacgttgacgctgaaaaagtagcgagcgctgccgaatcagcgcgcgtcctcgttgaagccgttaaaaacaacctgcgcccacgcgacatcattaccaagaaatccgttgagaatgcggttagcgtcatcatggcagttggcggttcaaccaatgcagtgttgcatttcttggcgattactagtgccgctgaaattgattggacaattgatgactttgaacggattcgtaagcaagtcccagtcatcgttgatatgaaaccctctggcacttatttagcaactgacttacaccaagctggcggtattccacaagtcatgaagattttgcttgacggtggcctgcttcatggcgattgcatcaccattaccggaaaaactattgctgaagtattaaaagatgttccatcagtgccgcgcgctgatcaaaaagtcattcgcacgctagacaacccactctacaagcaaggtcacttagcgattctgaagggcaatatttctccagaagggtgcgttgccaaaattactggcctcaagaatccatcgattactggcccagctcgagtctttgattctgaagatgatgcgatggctgccatcatggctcagaagatcaaagatggcgacatcgtggtgattcgttacgaaggccctaaaggcggtcctggtatgcgtgaaatgcttgcccctacctctgccctagttggtcaaggtttaggcgagtcagttggcctcatcaccgatggtcgcttctctggtggtacttggggcatggtagttggtcacgttgctcctgaggcctttgtagggggcacaattgccctcatcaacgaaggtgactcagtcacgatagatgctcaccaacttcttattcagctcaacgtcagcgaagaagaaattgctaagcgacgcgcagcttggaaacaacctaagccacgctatacccgcggcttacttgcgaagtatgcaagccttgctagtagtgcgagcaaaggtgctgtaaccgatttgaatttagatttgacctaa

SEQ ID NO: 328 - protein, 564 aa, Polynucleobacter sp.
MKRLNERSRMVTEGVARAPNRSMYYAMGYEEKDFVKPMVGVANGHSTITPCNSGLQKLADAAVEALEAAGAKAQVFGTPTVSDGIGMGTEGMKYSLVSREVIADSIEVCVNGLWQDGVVVIGGCDKNMPGGMMALARTNVPGIYVYGGTIKPGHFKGKELNIVSAFEAVGEFTSGRLSEEDLKGVEQHACPGSGSCGGMYTANTMSSSFEALGMSLPYSSTMANVDAEKVASAAESARVLVEAVKNNLRPRDIITKKSVENAVSVIMAVGGSTNAVLHFLAITSAAEIDWTIDDFERIRKQVPVIVDMKPSGTYLATDLHQAGGIPQVMKILLDGGLLHGDCITITGKTIAEVLKDVPSVPRADQKVIRTLDNPLYKQGHLAILKGNISPEGCVAKITGLKNPSITGPARVFDSEDDAMAAIMAQKIKDGDIVVIRYEGPKGGPGMREMLAPTSALVGQGLGESVGLITDGRFSGGTWGMVVGHVAPEAFVGGTIALINEGDSVTIDAHQLLIQLNVSEEEIAKRRAAWKQPKPRYTRGLLAKYASLASSASKGAVTDLNLDLT

SEQ ID NO: 329 - DNA, 1692 bp, Polynucleobacter necessarius
atgaaacgcctaaatgaacgctcgcgcatggtcacagaaggggtcgcacgcgcacctaatcgttcgatgtattacgcaataggttacgaagaaaaggatttcgtaaagccaatggttggcgttgcgaatggtcactccactatcaccccttgtaatagtggtttacaaaaattagccgatgctgcagtttctgcgcttgaaggtgctggtgcaaaagcacaaatgtttggcaccccaaccgtttccgatggcataggcatgggcacagaaggcatgaagtattcactcgtgtcacgcgaagtgattgctgacagtattgaaacttgtgtaaatggactgtggcaagacggtgtagttgtgattggcggctgcgataaaaatatgccaggcggcatgatggctttagctcgcaccaatgtgcccggcatctatgtatatggcggcacaattaagccaggccactacaaaggtaaagaccttaatatcgtttcagcgtttgaagcagttggtgaatttacctccggcagactcagcgaagaggatttaaaaggtgtagaacaacatgcctgtccgggtagcggctcctgcggtggtatgtataccgccaacacaatgagctcggcctttgaggccttaggcatgagcctcccctactcctcaacgatggcaaacgaagatgcagaaaaagtagcaagcacacatgattctgctgtcgtattggttgaagcgatcaaaaagaacttgcgtccacgcgacatcattaccaagaaatcgattgagaacgctgttagcgtaatcatggctgttggtggatctacaaatgcggtgctgcatttcttggcgattactagcgccgctgaaatcgattggaccattgatgattttgaacgcattcgtaagcgcgttcctgtaatcgtggatatgaaaccatcgggcacctaccttgctaccgatttgcatcaagctggcggcattcctcaagtgatgaagattttgctcgacgacggattgctccacggcgattgcatgactatcactggcaaaacagttgcggaagtgttgaaagatgttccatccgtaccgcgcgccgatcagaaagtgatccgtaccttagataatcctttgtataaacaaggtcacttggcaatcttgaaaggcaatatctcaccagagggttgtgtgaccaagataaccggcctcaaaaatccatcgatcaccggcccagcacgcgtctttgattctgaagatgatgctatggcagccatcatggcacagaagattaaagatggtgacatcgtggtcattcgctatgaaggccctaaaggcggccctggtatgcgcgaaatgcttgcccccacctctgccctagttggtcaaggtttaggcgaatctgtggggcttattaccgatggccgcttctctggtggcacttggggcatggtcgttggccacgtggcaccggaagcttatgtcggtggaaccatcgccctcattcatgagggtgactctgtcacgatcgatgcgcataagctactcattcagctgaatgtagatgatgcagagatcgctaaacgtcgcgcagcctggaagcaacccaagccacgctacacccgcggcttgcttgcaaagtatgccaaacttgctagcaccgcaagcaaaggggcggtgaccgacttaaatttgaatgattag

SEQ ID NO: 330 - protein, 563 aa, Polynucleobacter necessarius
MKRLNERSRMVTEGVARAPNRSMYYAIGYEEKDFVKPMVGVANGHSTITPCNSGLQKLADAAVSALEGAGAKAQMFGTPTVSDGIGMGTEGMKYSLVSREVIADSIETCVNGLWQDGVVVIGGCDKNMPGGMMALARTNVPGIYVYGGTIKPGHYKGKDLNIVSAFEAVGEFTSGRLSEEDLKGVEQHACPGSGSCGGMYTANTMSSAFEALGMSLPYSSTMANEDAEKVASTHDSAVVLVEAIKKNLRPRDIITKKSIENAVSVIMAVGGSTNAVLHFLAITSAAEIDWTIDDFERIRKRVPVIVDMKPSGTYLATDLHQAGGIPQVMKILLDDGLLHGDCMTITGKTVAEVLKDVPSVPRADQKVIRTLDNPLYKQGHLAILKGNISPEGCVTKITGLKNPSITGPARVFDSEDDAMAAIMAQKIKDGDIVVIRYEGPKGGPGMREMLAPTSALVGQGLGESVGLITDGRFSGGTWGMVVGHVAPEAYVGGTIALIHEGDSVTIDAHKLLIQLNVDDAEIAKRRAAWKQPKPRYTRGLLAKYAKLASTASKGAVTDLNLND

SEQ ID NO: 331 - DNA, 1704 bp, Azoarcus sp.
atgtccgaccctacccgtccagcccggatcgatgaacgttcccgcaacgtgaccgaaggcgtgatgcgggcgcccaatcgatcgatgtactacgcgatgggctatcgggaaactgatttcggcaagccgatggttggcgtggcgagcgcacattcgacgatcacgccctgcaacagcgggctgcaaccgctggccgataccgtggccgcggccttgaaggaggccggggccaatccgcaactgttcggtactcccaccgtgtccgacggcatcggcatgggcaccgagggcatgaagtattcgctggtatcgcgggaagtgatcgccgacagcatcgagacctgcgtcaatgggctgtggcaggacggggtcgtcgtgatcggcggatgcgacaagaacatgcccggcggcatgatggcgcttgtccgcaccaacgtgcctggaatctatgtctatggcggcacgatcaaaccggggcattacaagggcagggatctgaacatcgtctcggttttcgaggcggtgggggaattcatcgcggggcagctcgacccggtcgatttcaaggaaatcgaaaagcgcgcctgccccggcagcggctcgtgcggcgggatgtacacggcaaacacgatgagcgccgcgttcgaggcgctcggcatgagcctgccatattcttcgacgatggccaacgaggacgctgagaagctcgcgagcgccgcggagtccgcccgggtgctggtggaggcgatcaaacgcggccttcgcccgcgcgacatcgtcacccgggaggcgatcgagaacgctgtcagcgtgatcatggcgacgggaggctcgaccaacgcggtgctgcactttctggcgattgcccacgcggccgaagtgccgtggacaatcgacgacttcgagcgcattcggcgtcgcgtgccggtcatcgtcgacatgaagccgtccgggcgctacctcgcgaccgatctccatcaggcaggcggcatcccgcaggtgatgaagctgctgctcgacgccgggctgctgcatggcgcgtgcgtcacgatcaccgggcagacgatcgcggaggtcctggagaacgtgccggcggcaccgcgtgccgatcagggcgtcatccggacgctgtccgatccgctgtacgcggagggccatctggcgatcctcaggggcaacctctcgccggaaggctgcgtggcgaagatttcgggcctgaagaatcccgccatcaccggcccggcgcgcgtcttcgactccgaggacgacgcgatggcggcgatcatggcgcgccggatcgtggagggtgacgtcgtggtaatccgctacgagggacccaagggcggccccggcatgcgcgagatgctcgccccgacgtcggcgctcgtcgggcaggggctgggagagtcggtcgggctgatcactgacggccgcttctcgggaggcacctggggcatggtcgtcggccacgtttcccccgaagcgttcgtcggtggcccgattgcgctggttcgcgaaggggactcggtcacgatcgacgcgcaccggcagctcgtccagctgaatgtcggtgatgaagagctcgcgcgccgagccgccgactggacgccgccgtccccgcgctacacccgcggcgtgctggcgaagtttgcgaagttcgccagttccgcgagcaagggcgcggttaccgatctggacttgtag

SEQ ID NO: 332 - protein, 567 aa, Azoarcus sp.
MSDPTRPARIDERSRNVTEGVMRAPNRSMYYAMGYRETDFGKPMVGVASAHSTITPCNSGLQPLADTVAAALKEAGANPQLFGTPTVSDGIGMGTEGMKYSLVSREVIADSIETCVNGLWQDGVVVIGGCDKNMPGGMMALVRTNVPGIYVYGGTIKPGHYKGRDLNIVSVFEAVGEFIAGQLDPVDFKEIEKRACPGSGSCGGMYTANTMSAAFEALGMSLPYSSTMANEDAEKLASAAESARVLVEAIKRGLRPRDIVTREAIENAVSVIMATGGSTNAVLHFLAIAHAAEVPWTIDDFERIRRRVPVIVDMKPSGRYLATDLHQAGGIPQVMKLLLDAGLLHGACVTITGQTIAEVLENVPAAPRADQGVIRTLSDPLYAEGHLAILRGNLSPEGCVAKISGLKNPAITGPARVFDSEDDAMAAIMARRIVEGDVVVIRYEGPKGGPGMREMLAPTSALVGQGLGESVGLITDGRFSGGTWGMVVGHVSPEAFVGGPIALVREGDSVTIDAHRQLVQLNVGDEELARRAADWTPPSPRYTRGVLAKFAKFASSASKGAVTDLDL

SEQ ID NO: 333 - DNA, 1674 bp, Burkholderia phymatum
atgccgtacaaccgtcgttcgaagaacatcacgcaaggcgtcgcgcgttcgccgaaccgctcgatgtattacgcgctcggctaccagaaggcagacttcgacaagccgatgatcggcatcgccaacggccactcgaccatcacgccgtgcaacgcgggcctgcaacgactcgccgacgccgccgtcgaagccgtcaagcgcagcgatgcgaatccgcagaccttcggtacgccgaccatttcggacggcatgtcgatgggcacggagggcatgaagtactcgctcgtgtcgcgcgaagtgatcgccgactgcatcgagacctgcgtgcaggggcaatggatggacggcgtcgtcgtgatcggcggctgcgacaagaacatgccgggcggcatgatcggcctcgcgcgaatgaacgtgccaggcatctacgtgtacggcgggaccatcaagccgggcaactggaaaggcaccgacctgactatcgtgtcgtcgttcgaggcagtgggcgaattcacggcgggccgcatgtcgcaagaagacttcgaaggggtcgaacagaacgcctgcccgagcacgggctcgtgcggcggcatgtacacggccaacacgatgagctcgtcgttcgaagcgctcggtatgtcgctgctgtactcgtcgacaatggcgaacccggatcaggagaaagtggattcggcggccgagtcggcgcgcgtgctggtcgaagccgtcaagcaggatctcaagccgcgcgacatcattacgaagaagtcgatcgaaaacgccgttgcgctgatcatggcgacgggcggctcgacgaacgccgtgctgcactatctggccattgcgcacgcggcggaagtggactggtccatcgaagatttcgagcgcatgcgcaagaaagtgcccgtcatctgcgatctcaagccgtcgggcaagtatgtcgccaccgatctgcacaaggccggcggcatcccgcaggtgctgaagctgctgctcgatgcaggcctgctgcacggcgactgcatcacgatcacgggcaagacgatcgccgaagagctgaaggacgtgccagccaaaccgcgcgcggaccagaaggtgatctatccgatcgacaaggcgctttacagcgaaggccatctcgcgattctcaagggcaacctcgcggaagacggcgcggtcgcgaagatcaccgggctgaagaaccccgtcatcacagggcccgcacgcgtgttcgacgacgagcaaagtgcgatggaagccatcctcgccgaccagatcaaggcaggcgatgtcgtcgtgctgcgctatctcggcccgcaaggcggccccggcatgccggaaatgctggcgccgacctcggcgatcatcggcaagggtctcggcgaatcggtcggtcttatcacggatgggcgcttctcgggcggcacctggggcatggtggtgggtcacgtcgcgccggaagcgttcgtcggcggcacgatcgcactcgtgcaggaaggcgattcgatcaccatcgacgcccacaagctgctgttgcaactgaacgtcgacgacggcgaactgcagcgccgccgcgccgcatggaagcagcccgcgccgcgctatacgcgcggcgtgctggccaagttcgcggcgctcgcgaagccggccaacaagggcgccgtcaccggctga

SEQ ID NO: 334 - protein, 557 aa, Burkholderia phymatum
MPYNRRSKNITQGVARSPNRSMYYALGYQKADFDKPMIGIANGHSTITPCNAGLQRLADAAVEAVKRSDANPQTFGTPTISDGMSMGTEGMKYSLVSREVIADCIETCVQGQWMDGVVVIGGCDKNMPGGMIGLARMNVPGIYVYGGTIKPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIITKKSIENAVALIMATGGSTNAVLHYLAIAHAAEVDWSIEDFERMRKKVPVICDLKPSGKYVATDLHKAGGIPQVLKLLLDAGLLHGDCITITGKTIAEELKDVPAKPRADQKVIYPIDKALYSEGHLAILKGNLAEDGAVAKITGLKNPVITGPARVFDDEQSAMEAILADQIKAGDVVVLRYLGPQGGPGMPEMLAPTSAIIGKGLGESVGLITDGRFSGGTWGMVVGHVAPEAFVGGTIALVQEGDSITIDAHKLLLQLNVDDGELQRRRAAWKQPAPRYTRGVLAKFAALAKPANKGAVTG

SEQ ID NO: 335 - DNA, 1674 bp, Burkholderia xenovorans
atgccatacaaccgtcgttcgaagaacatcacgcaaggtgtagcgcgttcgccgaatcgctcgatgtactacgcgctcggctacgaaaaagccgacttcgacaagccgatgatcggcatcgccaacggtcactcgaccatcacgccgtgcaacgcgggcctgcagcgtctcgccgatgccgcggtcgccgcgatcaaaggcgccgacgcgaacccacagatcttcggcacgccgacgatctcggacggcatgtcgatgggcaccgagggcatgaagtactcgctggtgtcgcgcgaagtgatttccgactgcatcgagacctgcgtgcaaggccagtggatggacggcgtggtcgtgatcggcggctgcgacaagaacatgccgggcggcatgatcggcatgctgcgcaccaacgtgccgagcatctacgtgtatggcgggacgattcgtccgggcaactggaagggcaccgacctgaccatcgtgtcgtcgttcgaggccgtgggcgaattcaccgccggccggatgtcgcaggaagatttcgaaggggtcgaacagaacgcgtgcccatccaccgggtcgtgcggcggcatgtacaccgccaacaccatgagctcgtcgttcgaagcgctcggcatgtcgctgctgtattcgtccacaatggccaatccggatcaggaaaaagtcgactcggccgccgaatcggcacgcgtgctggtcgaagcggtcaagcaggatctcaagccgcgcgacatcgtgacccgcaagtcgatcgaaaacgccgtggccgtgatcatggccaccggcggctcgaccaatgccgtgctgcactttctcgccatcgcgcatgcggccgaagtggagtggagcatcgaggacttcgagcgcatgcgcaagaaggtgccggtgatctgcaacctgaagccgtcgggccagttcgtggcgaccgatctgcacaaggccggcggcattccgcaagtcatgaagatcctgctcgacgcaggtctgttgcacggcgattgcatcacgatcaccggccgaaccctcgcggaagagttgaaggacgtgccggccaggccgcgcgccgatcagcaggtgattttcccgatcgagcaggcgctgtacaaggaaggccatctcgcgatcctcaagggcaacctggccgtggacggcgcggtcgccaagatcaccggcctgaagaatcccgtgatcaccggcccggcgcgcgtgttcgacgacgagcaaagcgcgctggaagcgattctggccgacaggatcgtcgcgggcgacgtggtggtgctgcgctatctcggcccgaagggcggccccggcatgccggagatgctcgcgccgacctcggcgatcatcggcaagggactcggcgagagcgtggggctcatcaccgacgggcgcttctcgggtggcacgtggggcatggtggtcgggcacgtcgcgccggaagccttcgtgggcggcacgatcgcgttcgtgcaggaaggcgactcgatcaccatcgacgcgcacaagctgctgctgcaactgaatatcgacgacgccgaactggagcgacgccgtgccgcatggcagcagccgaagccgcgctacacacgcggcgtgctggcgaagtactccgcattggctctgccggccaataagggcgccgtgacgggctaa

SEQ ID NO: 336 - protein, 557 aa, Burkholderia xenovorans
MPYNRRSKNITQGVARSPNRSMYYALGYEKADFDKPMIGIANGHSTITPCNAGLQRLADAAVAAIKGADANPQIFGTPTISDGMSMGTEGMKYSLVSREVISDCIETCVQGQWMDGVVVIGGCDKNMPGGMIGMLRTNVPSIYVYGGTIRPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIVTRKSIENAVAVIMATGGSTNAVLHFLAIAHAAEVEWSIEDFERMRKKVPVICNLKPSGQFVATDLHKAGGIPQVMKILLDAGLLHGDCITITGRTLAEELKDVPARPRADQQVIFPIEQALYKEGHLAILKGNLAVDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIAFVQEGDSITIDAHKLLLQLNIDDAELERRRAAWQQPKPRYTRGVLAKYSALALPANKGAVTG

SEQ ID NO: 337 - DNA, 1674 bp, Burkholderia multivorans
atgtcgtacaaccgtcgctcgaagcacatcacgcaaggcgtcgcccgctcgccgaaccgttcgatgtattacgccctcggctatcagaaggaagatttcgacaagccgatgatcggcatcgccaacgggcattcgacgatcacgccgtgcaacgcggggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtaatcgccgactgcatcgagacctgcgtgcagggccaatggatggacggcgtcgtggtagtcggcggctgcgacaagaacatgccgggcgggatgatcgcgctcgcgcggctgaacgtgccgggcatctacgtgtacggcgggacgatccgccccggccactggaaaggcaaggatctgacgatcgtctcggcgttcgaggcggtcggcgaattcacggccgggcgcatgtcggacgaggatttcgagggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggcggccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgcgtgccggtgatctgcgacctgaagccgtcgggccagtacgtcgcgaccgacctgcaccgtgcgggcggcattccgcaggtgctgaagatcctgctcgatgcgggcctgctgcacggcgactgcgtcacgatcaccggccgcacgctcgccgaagagctgaaggacgtgccgtccgtgccgcgcgccgatcagcaggtgatcttcccgatcgagcgcgcgctgtacaaggagggccatctcgcgatcctgaagggcaatctcgccgaggacggcgcggtcgcgaagatcaccggcctgaagaacccggtgatcacgggcccggcgcgcgtgttcgacgacgagcaaagcgcgatggacgcgatcctcggcgacaagatccgcgccggcgacgtgctcgtgctgcgctatctcggcccgcaaggcgggcccggcatgccggaaatgctcgcgccgacgtcggcgatcatcggcaaggggctcggcgaatcggtcggcttcatcaccgacggccgcttctccggcggtacgtgggggatggtcgtcggccacgtcgcgcccgaggcgttcgtcggcggcacgatcgcgctcgtgcaggaaggcgactcgatcacgatcgacgcgcataagctgctgctgcagctgaacgtcgacgatgcggaactcgcgcgccgccgcgccgcatggaagcagccggcgccgcgctacacgcgcggcgtgctcgccaagtatgccgcgctcgcacggccggcgaatcggggtgcggtcacggggtga

SEQ ID NO: 338 - protein, 557 aa, Burkholderia multivorans
MSYNRRSKHITQGVARSPNRSMYYALGYQKEDFDKPMIGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGQYVATDLHRAGGIPQVLKILLDAGLLHGDCVTITGRTLAEELKDVPSVPRADQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTRGVLAKYAALARPANRGAVTG

SEQ ID NO: 339 - DNA, 1686 bp, Burkholderia cenocepacia
atggagctccccatgtcgtacaaccgccgctctaagaacatcacgcaaggcgtggcccgttcgccgaaccgctcgatgtattacgccctcggctaccagaaggacgatttcgataaaccgatggtcggtatcgcgaacggccactcgacgatcacgccgtgcaattccggcctgcagcgcctgtcggacgcggccgtggatgccgtgaaggcggccggcgcgaacccgcagatcttcggcacgccgacgatttcggacggcatgtcgatgggcaccgaagggatgaagtactcgctcgtgtcgcgcgaagtgatcgccgactgcatcgagacctgcgtgcagggccagtggatggacggcgtggtggtggtcggcggctgcgacaagaacatgcccggcggcatgatcgcgctcgcacgcctgaacgtgccgggcatctacgtgtacggcggcacgatccgcccgggcaactggaagggccgcgacctgacgatcgtgtcgtcgttcgaggccgtcggcgaattcaccgcgggccggatgtcgcaggaagacttcgaaggcgtcgagaagaacgcgtgcccgacgtcgggttcgtgcggcggcatgtacaccgcgaacacgatgagttcgtcgttcgaggcgctcgggatgtcgctgctgtattcgtcgacgatggcgaaccccgaccaggaaaaagtcgattcggccgccgaatcggcacgcatgctggtcgaggcggtgaagcgcgacctgaagccgcgcgacatcatcacgaaggaatccatcgagaacgcggtgtcggtgatcatggccaccggcggctcgaccaatgcggtgctgcactatctcgcgatcgcgcacgcggccgaagtcgactggacgatcgacgacttcgagcgcattcgcaagcgcgtgccggtgatctgcgacctgaagccgtcgggacaatacgtcgcgaccgacctgcaccgggccggcgggattccgcaggtgctgaagatcctgctcgatgcagggctgctgcacggcgactgcatgacgatcaccggccgcacgatcgccgacgagctgaaggacgtgccggccgtgccgcgcgcggaccagcatgtgatcttcccgatcgaccgcgcactgtacaaggaaggccacctcgcgatcctgaagggcaatctcgcggaagacggcgcggtcgcgaagatcaccggcctgaagaacccggtgatcacgggcccggcgcgcgtgttcgacgacgaacagagcgcaatggacgcgatcctcggcgaccggattcgcgcgggcgacatcctcgtgctgcgctacctcggcccgcagggtggccccggcatgccggaaatgctcgcgccgacttccgcgatcatcggcaaggggctcggcgaatcggtcggcttcatcacggacggacgcttctcgggcggcacttggggcatggtggtcggccacgtcgcgccggaggcgttcgtcgggggcacgatcgcgctggtgcaggaaggcgattcgatcacgatcgacgcgcaccggctgctgctgcaactgaacgtcgacgaggcggaactcgcacggcgccgtgccgcgtggcgacagccggcgccgcgctatacgcgcggggtgctcgcgaaattcgcggcgctcgcccgaccggcgaaccagggagcggtcacgggttga

SEQ ID NO: 340 - protein, 561 aa, Burkholderia cenocepacia
MELPMSYNRRSKNITQGVARSPNRSMYYALGYQKDDFDKPMVGIANGHSTITPCNSGLQRLSDAAVDAVKAAGANPQIFGTPTISDGMSMGTEGMKYSLVSREVIADCIETCVQGQWMDGVVVVGGCDKNMPGGMIALARLNVPGIYVYGGTIRPGNWKGRDLTIVSSFEAVGEFTAGRMSQEDFEGVEKNACPTSGSCGGMYTANTMSSSFEALGMSLLYSSTMANPDQEKVDSAAESARMLVEAVKRDLKPRDIITKESIENAVSVIMATGGSTNAVLHYLAIAHAAEVDWTIDDFERIRKRVPVICDLKPSGQYVATDLHRAGGIPQVLKILLDAGLLHGDCMTITGRTIADELKDVPAVPRADQHVIFPIDRALYKEGHLAILKGNLAEDGAVAKITGLKNPVITGPARVFDDEQSAMDAILGDRIRAGDILVLRYLGPQGGPGMPEMLAPTSAIIGKGLGESVGFITDGRFSGGTWGMVVGHVAPEAFVGGTIALVQEGDSITIDAHRLLLQLNVDEAELARRRAAWRQPAPRYTRGVLAKFAALARPANQGAVTG

SEQ ID NO: 341 - DNA, 1686 bp, Burkholderia mallei
atggagttccccatgtcgtacaaccgccgctcgaagaacatcacgcaaggcgtggcccgttcgccgaaccgctcgatgtattacgcgctcggctatcagaaggaagatttcgacaagccgatgatcggcatcgcgaacggccactcgacgatcacgccgtgcaacgcgggcctgcagcgtctgtcggacgccgccgtcgcggccgtcaaggacgccggcgcgaatccgcagatcttcggcacgccgacgatctcggacggcatgtcgatgggcaccgaagggatgaagtactcgctcgtgtcgcgcgaggtgatcgccgattgcatcgagacctgcgtgcagggccaatggatggacggcgtcgtcgtcgtgggcggctgcgacaagaacatgccgggcggcatgatcgcgctcgcgcggatcaacgtgccgggcatctacgtgtacggcggcacgatccgccccggccactggaaaggccacgacctgacgatcgtgtcgtcgttcgaggcggtcggcgagttcaccgccggacgcatgtcgcaggaggatttcgaaggggtcgaaaagaacgcgtgcccgacgacgggctcgtgcggcggcatgtataccgcgaacacgatgagctcgtcgttcgaggcgctcggcatgtcgctgctgtactcgtcgacgatggccaatcccgatcaggagaaggtcgattcggcggcggaatcggcgcgcgtgctggtcgaggcggtgaagaaggacctgaagccgcgcgacatcatcacgaagcagtcgatcgagaacgcggtgtcggtcatcatggccacgggcggctcgaccaacgcggtgctccactatctggcgatcgcgcacgcggccgagatcgactggtcgatcgaggatttcgagcgcatcaggaagcgcgtgccggtgatttgcgacctgaagccgtcgggccagtacgtcgcgaccgatctgcacgcggcgggcggcattccgcaggtgatgaagctgctgctcgacgcgggcctgctgcacggcgactgcatgacgatcacgggccgcacgctcgccgaggagctgaaggacgtgccgagcgtgccgcgcgccgatcagaaggtgatccatccgatcgaccaggcgctgtacaaggaaggccacctcgcgatcctgaagggcaacctcgccgaggacggcgcggtcgcgaagatcaccggcctgaagaacccggtcatcaccggcccggcgcgcgtgttcgacgacgagcagagcgcgctcgccgcgatcctcgacgacaggatccgcgcgggcgacgtcgtcgtgctgcgctacctcggcccgcaaggcggcccggggatgcccgagatgctcgcgccgacatcggcgatcatcggcaagggcctcggcgaatcggtcggcctgatcaccgacggccgcttctccggcggcacgtgggggatggtggtcggccacgtcgcgccggaagcgttcgtcggcggcacgatcgcgctcgtgcaggaaggcgattcgatcacgatcgacgcgcacaagctgctgctgcaattgaacgtcgacgacgccgaactcgcgcgccgccgcgccgcatggaagcagccggcgccgcgctacacgcgcggcgtgctcgcgaagtacgcggcgctcgcccgcccggcgaaccagggcgccgtcacgggctga

SEQ ID NO: 342 - protein, 561 aa, Burkholderia mallei
MEFPMSYNRRSKNITQGVARSPNRSMYYALGYQKEDFDKPMIGIANGHSTITPCNAGLQRLSDAAVAAVKDAGANPQIFGTPTISDGMSMGTEGMKYSLVSREVIADCIETCVQGQWMDGVVVVGGCDKNMPGGMIALARINVPGIYVYGGTIRPGHWKGHDLTIVSSFEAVGEFTAGRMSQEDFEGVEKNACPTTGSCGGMYTANTMSSSFEALGMSLLYSSTMANPDQEKVDSAAESARVLVEAVKKDLKPRDIITKQSIENAVSVIMATGGSTNAVLHYLAIAHAAEIDWSIEDFERIRKRVPVICDLKPSGQYVATDLHAAGGIPQVMKLLLDAGLLHGDCMTITGRTLAEELKDVPSVPRADQKVIHPIDQALYKEGHLAILKGNLAEDGAVAKITGLKNPVITGPARVFDDEQSALAAILDDRIRAGDVVVLRYLGPQGGPGMPEMLAPTSAIIGKGLGESVGLITDGRFSGGTWGMVVGHVAPEAFVGGTIALVQEGDSITIDAHKLLLQLNVDDAELARRRAAWKQPAPRYTRGVLAKYAALARPANQGAVTG

SEQ ID NO: 343 - DNA, 1674 bp, Ralstonia eutropha
atggcattcaacaaacgctcccgcaacatcacgcaaggtgtggcgcgttccccgaaccgctcgatgtactacgccctgggctaccagaaggaagacttcgacaagcccatggtcggcatcgccaacggccactcgacgatcacgccgtgcaacgccggcctgcagcgcctggccgacgccgcgatcgacgccgtgaaggcctcggacgccaatccgcaggtattcggcacgccgacgatctccgacggcatgtcgatgggcaccgagggcatgaagtactcgctgatctcgcgcgaagtcattgccgactgcatcgagaccgccgcccagggccagtggatggacggcgtggtggtgatcggcggctgcgacaagaacatgccgggcggcatgatcgcgctcgcgcgcaccaatgtgccgggcatctacgtctatggcggcaccatcaagcccggcaactggaagggcaaggacctgaccatcgtgtcgtcgttcgaggccgtgggcgaattcaccgccggccgcatgagcgaagaagatttcgagggcgtggaaaggaacgcttgtccgtcgaccggatcgtgcggcggcatgtacaccgccaatacgatgagctcgtcgttcgaggcgcttgggatgtcgctgctgtattcgtcgacgatggccaaccccgatcaggaaaaggtcgatagcgctgccgaatcggcgcgcgtgctggtcgaggcgatcaagaaggacatcaagccgcgcgacatcatcacgcgcaagtcgatcgaaaacgccgtcgcgctgatcatggccaccggtggctcgaccaacgcggtgctgcactacctggccattgcgcactcggccgaagtcgaatggaccatcgacgatttcgagcgcatccgtcgcaaggtgcctgtgatctgcaacctgaagccgtcgggccagtacgtggccaccgacctgcacaaggcgggcggcatcccgcaggtcatgaagatcctgctgaaggccggactgctgcatggcgactgcctgaccatcacaggccgcacgctggctgaagagctggaacacgtgccggaccagccgcgggccgaccaggacgtgatcatgccaatcgagaaggcgctctatgcggaggggcatctggcgatcctgaagggcaatctcgccgaggaaggcgcggtggccaagatcaccggcctgaagaatccggtcatcaccgggccggcgcgggtgttcgaggatgaacagagcgcgatggaggcgatcctggccgacaagatcaatgcgggggatgtgctggtgctgcgctatcttgggcccaagggcgggcccgggatgccggaaatgctggcgcctacgtcagccattattggcaaggggttgggagagtcggtgggcttcatcaccgatggccggttctccgggggcacctgggggatggtcgtcggccatgtcgcgccggaagcgtatgtaggcggcaatattgcgctcgtgcgggaaggggattcgatcacgatcgatgcgcacaagctggtgttgcaggtgaatgtgtcggatgaggagttggctcgccgccgggctgagtggaaacaacctgttgcgcgttatacacggggggtattggccaagtttgctcgactggcgtcgacggccagtaagggggcggtgacggattga

SEQ ID NO: 344 - protein, 557 aa, Ralstonia eutropha
MAFNKRSRNITQGVARSPNRSMYYALGYQKEDFDKPMVGIANGHSTITPCNAGLQRLADAAIDAVKASDANPQVFGTPTISDGMSMGTEGMKYSLISREVIADCIETAAQGQWMDGVVVIGGCDKNMPGGMIALARTNVPGIYVYGGTIKPGNWKGKDLTIVSSFEAVGEFTAGRMSEEDFEGVERNACPSTGSCGGMYTANTMSSSFEALGMSLLYSSTMANPDQEKVDSAAESARVLVEAIKKDIKPRDIITRKSIENAVALIMATGGSTNAVLHYLAIAHSAEVEWTIDDFERIRRKVPVICNLKPSGQYVATDLHKAGGIPQVMKILLKAGLLHGDCLTITGRTLAEELEHVPDQPRADQDVIMPIEKALYAEGHLAILKGNLAEEGAVAKITGLKNPVITGPARVFEDEQSAMEAILADKINAGDVLVLRYLGPKGGPGMPEMLAPTSAIIGKGLGESVGFITDGRFSGGTWGMVVGHVAPEAYVGGNIALVREGDSITIDAHKLVLQVNVSDEELARRRAEWKQPVARYTRGVLAKFARLASTASKGAVTD

SEQ ID NO: 345 - DNA, 1674 bp, Ralstonia metallidurans
atggcttacaacaaacgttcccagcacatcacgcaaggcgtggcgcgctcccccaaccgttcgatgtactacgcgctcggctacaagaaggaagacttcgacaagccgatggtgggtatcgccaacggccactcgacgatcaccccctgcaacgccggcctgcagcgcctggcggacgcggccgtggatgcgatcaaggcctcggacgccaacccgcagatcttcggcacgccgacgatctccgacggcatgtcgatgggcaccgagggcatgaagtactcgctgatctcgcgtgaagtcattgccgactgcatcgaaaccgctgcccagggccagtggatggacggcgtggtcgtgatcggcggctgcgacaagaacatgcccggcggcatgatcgcactggcgcgcaccaacgtgccgggcatctacgtctacggcggcaccatccgcccgggtaactggaagggcaaggacctgaccatcgtgtcgtcgttcgaggccgtgggcgaattcaccgccggccgcatgagcgaggaagacttcgagggcgtggagaagaacgcctgcccgagcaccggctcgtgcggtggcatgtacaccgccaacacaatgagctcgtcgttcgaggcgctgggcatgtcgctgctgaattcgtcgacgatggccaacccggaccaggaaaaggtggacagcgccgccgaatcggcccgcgtgctggtggaagccatcaagaaggacatcaagccgcgcgacatcatcacgcgcaaatcgatcgagaacgccgtgacgctgatcatggccacgggcggttccaccaacgcggtactgcattacctggccatcgcccactcggccgaagtggaatggaccatcgacgatttcgagcgcatccgccgccgcgtgccggtgatctgcaacctgaagccgtcgggcgcctacgtggccaccgacctgcaccgcgccggtggcattccgcaagtgatgaagatcctgctgaacgccggtctgctgcatggcgactgcctgacgatcacgggccgcacgctggccgaggagctcgagcacgttcccaatgagccgcgtaccgaccaggacgtgatcctgccgatctcgcaggccctgtacaagcaaggccacctggccatcctgaagggcaacctcgccgaggaaggcgcagtggccaaaatcaccggcctgaagaacccggtcatcaccggcccggcccgcgtgttcgaggacgaacagagcgccatggaagcgatcctggcggacaagatcaacgctggcgacatcctggtgctgcgctaccttggcccgaagggcggcccgggcatgcctgaaatgctggcgccgacttcggcgatcatcggcaagggtctcggcgaatcggttggtttcatcaccgacggccgcttctcggggggcacctggggcatggtggttggccacgttgcgccggaagcccatgtgggcggtacgattgcactggttcaggaaggcgactcgatcacgatcgacgcgcaccagctgctgctgcaactgaatgtggccgacgacgagctggcccgccgccgcgctgcctggaaacagccggcgccgcgctacacgcgcggcgtactggcgaagttcgcgaggctggcctccacggccagcaagggcgccgtgacggactga

SEQ ID NO: 346 - protein, 557 aa, Ralstonia metallidurans
MAYNKRSQHITQGVARSPNRSMYYALGYKKEDFDKPMVGIANGHSTITPCNAGLQRLADAAVDAIKASDANPQIFGTPTISDGMSMGTEGMKYSLISREVIADCIETAAQGQWMDGVVVIGGCDKNMPGGMIALARTNVPGIYVYGGTIRPGNWKGKDLTIVSSFEAVGEFTAGRMSEEDFEGVEKNACPSTGSCGGMYTANTMSSSFEALGMSLLNSSTMANPDQEKVDSAAESARVLVEAIKKDIKPRDIITRKSIENAVTLIMATGGSTNAVLHYLAIAHSAEVEWTIDDFERIRRRVPVICNLKPSGAYVATDLHRAGGIPQVMKILLNAGLLHGDCLTITGRTLAEELEHVPNEPRTDQDVILPISQALYKQGHLAILKGNLAEEGAVAKITGLKNPVITGPARVFEDEQSAMEAILADKINAGDILVLRYLGPKGGPGMPEMLAPTSAIIGKGLGESVGFITDGRFSGGTWGMVVGHVAPEAHVGGTIALVQEGDSITIDAHQLLLQLNVADDELARRRAAWKQPAPRYTRGVLAKFARLASTASKGAVTD

SEQ ID NO: 347 - DNA, 1674 bp, Ralstonia solanacearum
atgccagacaacaagcgttcccagcacatcacccagggcgtggcacgctcgcccaaccgctcgatgtactacgcgctgggctaccagaaagaagacttcaacaatccgatgatcggcgtggccaacggccattcgaccatcacgccgtgcaactcgggcctgcagaaactggccgacgcggccgtggccgccgtcaaggcatcgaacgccaacccgcagatcttcggcacgcccaccatttccgacggcatgtcgatgggcaccgagggcatgaagtattcgctgatctcgcgcgaggtcatcgccgactgcatcgagacctgcgcacaaggccagtggatggacggcgtggtcgtgatcggcggctgcgacaagaacatgcccggcggcatgatcgcgctggcacgcaccaacgtgccgggcatctacgtgtacggcggcaccatccggccggggcactggaagggcaaggacctgaccatcgtgtcgtcgttcgaggccgtgggcgagttcaccgccggccgcatgagcgacgaagacttcgagggcatcgagaagaacgcctgcccgtcgagcggctcgtgcggcggcatgtacaccgccaacacgatgagctcgtcgttcgaggcgctgggcatgtcgctgctgtattcgtcgaccatggccaaccccgaccaggagaaggtcgacagcgccgccgaatcggcccgcgtgctggtcgaggccgtgcgccgcgacctcaagccgcgcgacatcatcacgcgcaagtcgatcgagaacgccgtggccgtcatcatggcgaccggcggctcgaccaacgccgtgctgcactacctggccatcgcccatgccgccggcgtggaatggaccatcgatgacttcgagcgcgtgcgccagcgcgtgcccgtgatctgcaacctgaagccgtcgggccagtatgtcgccaccgacctgcaccgcgcgggcggcatcccgcaggtgatgaagatcctgctgaacgcgggcctgctgcacggcgactgcatcaccatcaccggcaagacgctggccgaggaactcgccaacgtgcccgaccagccgcgcgcggaccaggacgtgatcctgccgctcgacaaggcgctctaccagcagggccacctcgccatcctcaagggcaacttggccgaggaaggcgccgtggcgaagatcaccggcctgaagaacccggtcatcaccggcccggcgcgcgtgttcgacgatgagcagagcgcgatggaagccatcctgggcgacaaaatcaacgccggcgacgtgctggtgctgcgctacctcggtccgaagggcggcccgggcatgccggaaatgctggccccgacgtcggccatcatcggcaagggcctgggcgaatcggtcggcttcatcaccgatggacgcttctcgggcggcacctggggcatggtggtcggccacgtcgcgccggaagccttcgtgggcggcaccatcgccctggtgcaggaaggcgattcgatcaccatcgacgcgcaccagcgcgtgctgcagctgaacgtgccggaagacgaactggcccgccgccgcgccgcgtggcagcagccggcaccgcgctatacgcgcggcgtgctcgccaagttcgctcagttggcgtcgacggccagcaagggcgccgtgaccggctga

SEQ ID NO: 348 - protein, 557 aa, Ralstonia solanacearum
MPDNKRSQHITQGVARSPNRSMYYALGYQKEDFNNPMIGVANGHSTITPCNSGLQKLADAAVAAVKASNANPQIFGTPTISDGMSMGTEGMKYSLISREVIADCIETCAQGQWMDGVVVIGGCDKNMPGGMIALARTNVPGIYVYGGTIRPGHWKGKDLTIVSSFEAVGEFTAGRMSDEDFEGIEKNACPSSGSCGGMYTANTMSSSFEALGMSLLYSSTMANPDQEKVDSAAESARVLVEAVRRDLKPRDIITRKSIENAVAVIMATGGSTNAVLHYLAIAHAAGVEWTIDDFERVRQRVPVICNLKPSGQYVATDLHRAGGIPQVMKILLNAGLLHGDCITITGKTLAEELANVPDQPRADQDVILPLDKALYQQGHLAILKGNLAEEGAVAKITGLKNPVITGPARVFDDEQSAMEAILGDKINAGDVLVLRYLGPKGGPGMPEMLAPTSAIIGKGLGESVGFITDGRFSGGTWGMVVGHVAPEAFVGGTIALVQEGDSITIDAHQRVLQLNVPEDELARRRAAWQQPAPRYTRGVLAKFAQLASTASKGAVTG

SEQ ID NO: 349 - DNA, 1674 bp, Ralstonia pickettii
atgccagacaacaagcgttcccagcacatcactcagggcgtggcgcgctcgcccaaccgctcgatgtactacgcgctgggctacacaaaagacgacttcaacaatccgatgatcggtgtggccaacggccattcgaccatcacgccatgcaactcgggcctgcagaagctggccgatgccgccgtggctgcaataaaggacgcccgcgcgaatccgcagatcttcggcacgcccaccatttccgatggcatgtcgatgggcacggaaggcatgaagttctcgctgatctcgcgcgaagtgattgccgactgcatcgagacctgcgtcaacggccaatggatggacggtgtggtcgtcatcggcggctgcgacaagaacatgccgggcggcatgatcgccctggcgcgcacgaatgtgccgggcatctacgtgtacggcggcaccatcaagccggggcactggaagggcaaggacctgaccatcgtctcgtcgttcgaggccgtgggcgaattcaccgccggccgcatgagcgaggaagacttcgagggcatcgaaaaaaacgcctgcccgtcgagcggttcgtgcggcggcatgtacacggccaacacgatgagttcgtcgtttgaagcgctaggcatgtcgttgctgtattcatcgacgatggccaatcccgatcaggagaaggtcgacagcgccgccgaatccgctcgcgtgttggttgatgccgtgcgccgcgacctgaagccgcgcgacatcatcacgcgcaagtccatcgagaacgctgtcgccgtcatcatggcaaccggtggctcgaccaacgccgtgctgcactacctggccatcgctcacgctgcggaagtggaatggacgatcgacgacttcgagcgggtgcgccagcgcgtgcccgtcatctgcaacctcaagccgtcgggccagtacgtggccaccgacctgcacgaggccggcggcatcccgcaggtgatgaagctgctgctcaacgccggcctgctgcatggcgattgcatcaccatcaccggcaagacgctggcggaagaactcgcccacgtgcccgaccagccgcgcgctgatcagaacgtgatcctgccgattgacaaggcgctctacaaggaaggccacctcgccatcctgaagggcaatctggccgaagaaggcgccgtggcgaagatcaccgggctgaagaatcccgtcatcaccggcccggcccgcgtgttcgaggacgagcaaagtgcgatgagcgcgatcctgggcgaccagatcaaggccggcgatattctggtgctgcgctatctggggccgaagggcggccccggcatgccggagatgctggccccgacctcggccatcatcggcaagggcctgggcgagtcagtcggcttcattaccgacggacgcttctcgggcggtacgtggggcatggtggtcggccacgtcgcaccggaagcctacgtgggaggcacgattggattggtgcacgaaggggattcgatcaccatcgacgcgcaccagcggctgctgcaattgaacgtgccggacgacgagcttgcccgccgccgcgccgcgtggaagcaacctgcgccgcgctatacgcgtggcgtgctggcgaagtttgcaaaactggcagcaacggccagcaagggtgcggtaacggactga

SEQ ID NO: 350 - protein, 557 aa, Ralstonia pickettii
MPDNKRSQHITQGVARSPNRSMYYALGYTKDDFNNPMIGVANGHSTITPCNSGLQKLADAAVAAIKDARANPQIFGTPTISDGMSMGTEGMKFSLISREVIADCIETCVNGQWMDGVVVIGGCDKNMPGGMIALARTNVPGIYVYGGTIKPGHWKGKDLTIVSSFEAVGEFTAGRMSEEDFEGIEKNACPSSGSCGGMYTANTMSSSFEALGMSLLYSSTMANPDQEKVDSAAESARVLVDAVRRDLKPRDIITRKSIENAVAVIMATGGSTNAVLHYLAIAHAAEVEWTIDDFERVRQRVPVICNLKPSGQYVATDLHEAGGIPQVMKLLLNAGLLHGDCITITGKTLAEELAHVPDQPRADQNVILPIDKALYKEGHLAILKGNLAEEGAVAKITGLKNPVITGPARVFEDEQSAMSAILGDQIKAGDILVLRYLGPKGGPGMPEMLAPTSAIIGKGLGESVGFITDGRFSGGTWGMVVGHVAPEAYVGGTIGLVHEGDSITIDAHQRLLQLNVPDDELARRRAAWKQPAPRYTRGVLAKFAKLAATASKGAVTD

SEQ ID NO: 351 - DNA, 1689 bp, Limnobacter sp.
atgagcatcaatcgacgttccaagaacattacccagggcgtggcccgttcgcccaaccgcgcgatgtatttcgccatgggttacaaagacgaagacttcaataaccccatgattggcattgccaatggccattccacgatcacgccttgcaacagcggcttgcagcctttggcagatgcggctgtgaaagcagtgaaagaggctggtggcaatccacaaattttcggcacccccaccatctccgatggcatgagcatgggcaccgaaggcatgaagtattcactggtcagccgcgaggtcatcgcggactgcatcgaaactgcggtacagggccagtggatggacggcgtgttggtgatcggcggctgcgacaagaacatgcccggcggcatgatcggcatggcccgcatgaacgtgccaggcatttacgtttatggcggcactatcaagccggggcgttacaaaggcaaagacctgaccattgtgtctgccttcgaagccgtgggcgaattcacggctggccgcatgagcgaggaagacttcaagggtatagagaagaacgcctgcccgagttccggttcctgtggtggcatgtacaccgccaacaccatgagctcggcattcgaagctttgggcatgagcctgccctactccagcaccatgtcgaacattgacgcagagaaagtcacttcaactgaagagtccgctcgcgtcttgatcgaagcggttcgcaacgacttgaagccccgcgacatcatcaccaagaagtcgattgaaaatgctgtggccgtgctgatggccaccggtggttccaccaacgcggtactgcacttcctggccattgcaaaagcagcagatgtggcctggagctacgaagactttgaacgcgtgcgcttgcgcacaccagtcatttgcaacctgaagccttctggccaatacgttgccactgacctgcacgatgccggtggtattccacaagtcatgaaaattttgttggatgcgggcctgttgcatggcgattgcatcaccatcactggcaaaaccattgcagaaaccctggccgatattccttcagtgccccgcgcggatcaaaacgtgatcatgccgatcgaaaaagccctgtacaagcaaggccacttggcgattctgaaaggcaacctggcacccgaaggtgctgtggccaagatcacaggcctcaaaaaccctgtaattaccggaccagccaaggtttttgacgacgagcaaagcgcgatggacgcaattttgggcgacaagatcaaagacggcgacgtgattattcttcgctacttgggccccaaaggcggtccaggcatgccggaaatgttggccccaacctcggcaattattggcaagggcttgggagaaacagtcggcctgatcaccgacggccgcttttccggtggcacctggggtatggtggtcggccacgttgcgccagaggcctacgttggcggcccgatcgcgctgatcaaggaaggtgactccatcacgatggacgcacatcagaaattgttacagatcaacgtgagcgaggaagaactggcgaagcgtcgtgaaagttgggtaaaacccaagccacgctacaccactggtgtgctggccaaattcgcagccttggccagtagcgccagcaagggtgcagtcaccgatggcgatctcgacctctaa

SEQ ID NO: 352 - protein, 562 aa, Limnobacter sp.
MSINRRSKNITQGVARSPNRAMYFAMGYKDEDFNNPMIGIANGHSTITPCNSGLQPLADAAVKAVKEAGGNPQIFGTPTISDGMSMGTEGMKYSLVSREVIADCIETAVQGQWMDGVLVIGGCDKNMPGGMIGMARMNVPGIYVYGGTIKPGRYKGKDLTIVSAFEAVGEFTAGRMSEEDFKGIEKNACPSSGSCGGMYTANTMSSAFEALGMSLPYSSTMSNIDAEKVTSTEESARVLIEAVRNDLKPRDIITKKSIENAVAVLMATGGSTNAVLHFLAIAKAADVAWSYEDFERVRLRTPVICNLKPSGQYVATDLHDAGGIPQVMKILLDAGLLHGDCITITGKTIAETLADIPSVPRADQNVIMPIEKALYKQGHLAILKGNLAPEGAVAKITGLKNPVITGPAKVFDDEQSAMDAILGDKIKDGDVIILRYLGPKGGPGMPEMLAPTSAIIGKGLGETVGLITDGRFSGGTWGMVVGHVAPEAYVGGPIALIKEGDSITMDAHQKLLQINVSEEELAKRRESWVKPKPRYTTGVLAKFAALASSASKGAVTDGDLDL

SEQ ID NO: 353 - DNA, 1674 bp, Herminiimonas arsenicoxydans
atggcattcaatcgccgctcgaaaaacatcacgcaaggcgtgtcccgcagtcctaaccgttccatgtattacgccatgggttacgaaaaggccgatttcgacaagcctatggtcggcatcgccaacggtcactcgacgattacgccatgtaactccggcctgcaaaaactggccgatatcgcgatcaagaccatcaaggatgcaggcggcaatccgcaagtgttcggtacgccgacgatttccgacggcatgtccatgggcaccgaaggcatgaagtattcgctgatttcgcgcgaagtcattgccgactgtatcgaaaccgcagtcaacggccaatggatggatggcgtgctggtcatcggcggctgcgacaagaatatgccgggcggcatgatcgccatgttgcgcaccaacgtgcctagtatttatgtctacggcggcaccatcaagccggggcactggaaaggcaaagacctgaccatcgtttccgcgtttgaagcggtcggcgaattcactgccggccgcatgtcacaagaagattttgacggcatcgaacgcaatgcctgcccatcatccggttcctgcggcggcatgtatacagccaataccatgtcgtcctcgttcgaggcgctgggcctggccttgccttactcgtcgacgatggccaatcctgacgatgaaaaagtcggctccgcagcggaatccgcgcgcgtgctgatcgaagcaatcaagaaggatctgaagccgcgcgacatcgtgacacgcaaggctatcgaaaacgcagtggccgtcatcatggcaaccggcggttcgaccaatgccgtgctgcacttcctggcgattgcgcacgctgcagaaatcgactggaccatcgacgacttcgaacgcatgcgcaaaaaagtccctgtcatctgcgatctgaaaccatccggcaaatacgtggcaaccgatctgcataaggccggcggcattccgcaagtgatgaaggtgttgctcgacgccggcttgttgcacggtgattgcatgacgatcaccggccagaccgttgcagaagcgctggcgcacatcccgtcggtaccaagtgccgaccaggacgtgatccacaccatcgacaaggctttgtacgcacaaggtcaccttgcaatcctgaagggcaatctgtcgcctgaaggttgcgtggcaaaaatcaccggtctgaaaaatcctgtcatcaccggacctgcacgcgtatttgacgacgaatactcggcaatggacgccatcatggcgaaccagatcaaggccggcgacgtactcgtcatgcgctacctcggacctaaaggcggcccgggcatgccggaaatgctggcaccgacttccgcactggtcggtcagggtctgggtgagtcagtcggcttgattaccgatggccgtttctccggcggtacctggggcatggtggttggccacgtttcgccggaagcgtttgtcggcggtaccatcggtctggtggaagaaggcgattccgtcaccatcgatgcgcgtcaattgctgattcagttgaacgtatcggaagaggaaatcgcacgccgtcgcgccaactggaagcagcctgcaccgcgttacacacgtggcgtgctggcaaaatatgcagctctggcatcgacggcaagcaaaggcgctgtcaccggctga

SEQ ID NO: 354 - protein, 557 aa, Herminiimonas arsenicoxydans
MAFNRRSKNITQGVSRSPNRSMYYAMGYEKADFDKPMVGIANGHSTITPCNSGLQKLADIAIKTIKDAGGNPQVFGTPTISDGMSMGTEGMKYSLISREVIADCIETAVNGQWMDGVLVIGGCDKNMPGGMIAMLRTNVPSIYVYGGTIKPGHWKGKDLTIVSAFEAVGEFTAGRMSQEDFDGIERNACPSSGSCGGMYTANTMSSSFEALGLALPYSSTMANPDDEKVGSAAESARVLIEAIKKDLKPRDIVTRKAIENAVAVIMATGGSTNAVLHFLAIAHAAEIDWTIDDFERMRKKVPVICDLKPSGKYVATDLHKAGGIPQVMKVLLDAGLLHGDCMTITGQTVAEALAHIPSVPSADQDVIHTIDKALYAQGHLAILKGNLSPEGCVAKITGLKNPVITGPARVFDDEYSAMDAIMANQIKAGDVLVMRYLGPKGGPGMPEMLAPTSALVGQGLGESVGLITDGRFSGGTWGMVVGHVSPEAFVGGTIGLVEEGDSVTIDARQLLIQLNVSEEEIARRRANWKQPAPRYTRGVLAKYAALASTASKGAVTG

SEQ ID NO: 355 - DNA, 1785 bp, Bordetella parapertussis
atgtccgataataaccggcgagcgtgttgttccgtagcgctgccttccgacagcgatctggccggcccggcatgggcctacgcacctggagacaagaccatgtccgacaacaatcgttcccgtcacattaccgagggcgtggcgcgcgcgcccaatcgggccatgtactacgcgctgggctacaccgaggcggatttccagaatccgatgatcggcgtggccaacggacattccacgatcactccatgcaacagcgggctgcagcgcctggccgacgcggcgatcgaggccatccgcgtctcccgcgccaacccccaggtgttcggcacgccgacgatttccgatggcatgtccatgggcaccgaaggaatgaagtattcgctggtgttgcgcgaggtcatcgccgactgcatcgagaccgccgcgcaggggcagtggatggatggcgtggtggtcatcggcggatgcgacaagaacatgcccggcggcatgatggcgctcgcgcgcatgaatgtgcccggcatctacgtgtatggcggcaccatcaagcccggccactacaagggcaaggacctgaccatcgtatcggtgttcgaagccgtcggcgaatacaccatgggccgcatggacgaaaccgacttcaaggccatcgagcaatgcgccatccccgggtcgggttcctgcggcggcatgtacacggccaacaccatgagctcggccttcgaggccatggggatgagcctgcctcattccagcaccatggccaacgaggaccaggagaaagtcgcgtcggcggcggaatcggcgcgcgtgctggtcgaggcggtgcggcgccagctgcggccgcgcgacatcatcacccgcgcttccatcgagaacgccgtggcggtgatcatggccacgggcggctcgaccaacgccgtgctgcacttcctcgccatcgcccacgcggcggaagtgccgtggaacatcgacgacttcgagcgcatccgcaagcgcgtgccggtcatctgcgatctcaagccgtccggcaagtacgtggcgaccgacctgcatcgcgccggcggcatcccacaagtgatgaagatcctgctgaacgccggcctgttgcatggcgattgcatcaccatcaccggcaagaccgtggccgagacgctggcgaacgtacccgatgcgccgccgcccgggcaggacgtcatcatgcccatcgaacgcgcgttctacccgcaggggcacctggcgatactcaagggcaatctttcgccggaaggctgcgtggccaagatcaccgggttgaagaatccggtcattaccggcccggcgcgcgtgttcgattccgaagacgatgccatgtccgccatcatggaccgccgcatccgcgatggcgatgtggtggtgatccgctacgagggccccaagggcggtccaggcatgcgcgagatgctcgcgcccacttccgcgctggtcggccaggggttgggcgaaaccgtcggcctgatcaccgacgggcggttttccggcggcacctggggcatggtggtcgggcacgtggcgcccgaggcgttcgtcggcgggccgatcgcgctgattcgcgagggcgattcggttaccatcgatgcccatcagctgctgctgcagctcaacatcagcgatgaggaaatggcggctcgtcgcaaggcttgggcccagcccaagccgcgctatgtgcgcggcgtgcttgccaagttcggcaagctggcctgtaccgccagccgtggggcagtaaccgatgcatttgaagagtag

SEQ ID NO: 356 - protein, 594 aa, Bordetella parapertussis
MSDNNRRACCSVALPSDSDLAGPAWAYAPGDKTMSDNNRSRHITEGVARAPNRAMYYALGYTEADFQNPMIGVANGHSTITPCNSGLQRLADAAIEAIRVSRANPQVFGTPTISDGMSMGTEGMKYSLVLREVIADCIETAAQGQWMDGVVVIGGCDKNMPGGMMALARMNVPGIYVYGGTIKPGHYKGKDLTIVSVFEAVGEYTMGRMDETDFKAIEQCAIPGSGSCGGMYTANTMSSAFEAMGMSLPHSSTMANEDQEKVASAAESARVLVEAVRRQLRPRDIITRASIENAVAVIMATGGSTNAVLHFLAIAHAAEVPWNIDDFERIRKRVPVICDLKPSGKYVATDLHRAGGIPQVMKILLNAGLLHGDCITITGKTVAETLANVPDAPPPGQDVIMPIERAFYPQGHLAILKGNLSPEGCVAKITGLKNPVITGPARVFDSEDDAMSAIMDRRIRDGDVVVIRYEGPKGGPGMREMLAPTSALVGQGLGETVGLITDGRFSGGTWGMVVGHVAPEAFVGGPIALIREGDSVTIDAHQLLLQLNISDEEMAARRKAWAQPKPRYVRGVLAKFGKLACTASRGAVTDAFEE

SEQ ID NO: 357 - DNA, 1686 bp, Bordetella petrii
atgcccagcaacgaacgttcacgccacatcacgcaaggcgtcgcccgcgcgcccaaccgggccatgtattacgcgctgggctaccaggaagccgatttcgacaaccccatgatcggcgtggccaacggccattccaccatcaccccctgcaacagcggcctgcagcggctggccgacgcggccatcgatgccgtgcgcgcggcccgcgccaatccgcaggtgttcggcacccccaccatatccgacggcatgtcgatgggcaccgagggcatgaaatactcgctggtgtcgcgcgaagtcattgccgactgtatcgagaccgccgtgcagggccagtggatggacggcgtcgtggtcatcggcggctgcgacaagaacatgcccggcggcatgatcgcgctggcccgcatgaacgtgccaggcatctacgtgtatggcggcaccatcaagccgggccgctataaagggcaagatctcactatcgtgtccgtgttcgaagccgtcggtgagtacaccatggggcgcatggacggcgaagatttccgccagatcgaaaaatgcgccattcccggctcgggctcgtgcggcggcatgtacaccgccaacaccatgagttcggccttcgaagccatgggcatgagcctgccgtattccagcaccatggccaacgaagacgacgaaaaaatcgcctcggccgccgagtccgcccgcgtgctggtcgatgccgtgcggcgcgacgtgcggccgcgcgacatcatcacgcgcgaatccatcgaaaacgccgtgtcggtcatcatggccacgggcggctccaccaatgccgtgctccatttcctggccatcgcccacgccgccgaagttcaatggaccatcgacgacttcgagcgcatccgccggcgcgtgccggtcatctgcgacctcaaaccttcgggccgatacgtggccaccgatctgcaccgcgccggcggcgtcccgcaagtcatgaagctgctgctcgctgccggcttgctgcatgggcattgcatgaccatcaccggcaagaccatcgccgaaacgctcgccgacgtgcccgccgagccgccggccggccaggatgtcatccggcctatcggccgcgcgctgtacccgcagggccatctggccatcctcaagggcaacctgtcgcccgagggctgcgtggccaagatcacgggcctgaagaatcccgtcatcaccggcccggcgcgcgtgttcgattcagaagacgacgccatggccgccatcatggaacggcgcattcgcgctggcgacgtggtggtcatccgctacgaagggcccaagggcggtcccggcatgcgcgaaatgctggcgcccacctcggcgctggtggggcagggcctgggcgaaagcgtcggcctcattaccgatggccgcttctcgggcggcacctggggcatggtcgtgggccatgtcgcgcccgaggcctatgtgggcggccccattgccctgatccgcgaaggcgattcggttaccatcgacgctcaccaattgttgttgcagctcaatatttctgacgacgaaatggcggcgcgccgcaaggcctgggtccagccccggccgcggtacacgcgcggcgtgcttgccaagttcggcaagctggccggcaccgccagtcgcggggcagttaccgatgcatttgaagcatag

SEQ ID NO: 358 - protein, 561 aa, Bordetella petrii
MPSNERSRHITQGVARAPNRAMYYALGYQEADFDNPMIGVANGHSTITPCNSGLQRLADAAIDAVRAARANPQVFGTPTISDGMSMGTEGMKYSLVSREVIADCIETAVQGQWMDGVVVIGGCDKNMPGGMIALARMNVPGIYVYGGTIKPGRYKGQDLTIVSVFEAVGEYTMGRMDGEDFRQIEKCAIPGSGSCGGMYTANTMSSAFEAMGMSLPYSSTMANEDDEKIASAAESARVLVDAVRRDVRPRDIITRESIENAVSVIMATGGSTNAVLHFLAIAHAAEVQWTIDDFERIRRRVPVICDLKPSGRYVATDLHRAGGVPQVMKLLLAAGLLHGHCMTITGKTIAETLADVPAEPPAGQDVIRPIGRALYPQGHLAILKGNLSPEGCVAKITGLKNPVITGPARVFDSEDDAMAAIMERRIRAGDVVVIRYEGPKGGPGMREMLAPTSALVGQGLGESVGLITDGRFSGGTWGMVVGHVAPEAYVGGPIALIREGDSVTIDAHQLLLQLNISDDEMAARRKAWVQPRPRYTRGVLAKFGKLAGTASRGAVTDAFEA

SEQ ID NO: 359 - DNA, 1695 bp, Polaromonas sp.
atggaaaccaagaccattcagctcaacccccgcagcaaaaacatcaccgaaggcaaatcgcgcgcgcccaaccgctcgatgtactacgccatgggctatgaagaggccgacttcaagaagcccatgattggtgtggccaacgggcacagcaccatcaccccctgcaacagcggcctgcaaaagctggcggacgcggccattgccggcattgaagaagccggcggcaacgcccaggtgttcggcacgcccaccatctcggacggcatggccatgggcaccgagggcatgaagtactcgctggtcagccgcgaagtgatctccgactgcatcgaaacctgcgtgcagggccagtggatggacggcgtgctggtgatcggcggctgcgacaagaacatgcccggcggcctgatgggcatgctgcgcgccaacgtgccggccatctacgtctatggcggtaccattttgccgggcagctacaagggcaaagacctcaacatcgtcagcgtgtttgaagccgtcggcgaaaacgcagcaggccgcatgagcgatgaagacctgctgcaaatcgagcgccgcgccattcccggcaccggtagctgcggcggcatgtacacggccaacaccatgtccagcgccttcgaggcgctcggcatttcgctgccctactccagcaccatggccaatccgcacgacgagaaaatgaactcggccagggagtccgccaaggtcctggtcgaagccatcaagaaagacatcaagccgcgcgatctcgtcacgaagaaagccattgaaaacgccgtggcagtgatcatggccacgggcggctccaccaatgccgtgctgcacttcctggcgattgcgcatgccgccggcgtggactggacaatcgacgacttcgaacgcgtgcgccaaagaacgccggtgctgtgcgacctgaagccgtccggcaagtacctggccgtggacctgcaccgcgccggcggcattccgcaggtcatgaagatgctgctggcggccggcctgctgcatggcgactgcctgacgatcaccggccaaaccattgccgaggtgctgaaggatgtgcccgaagcgccgcgcgccgaccaggacgtgattcgccccatcagcaaccccatgtacgcccagggccacctggccatcctgaagggcaacctctcgcctgaaggctgcgtggccaaaatcaccggcctgaaaaacccggtcatgacgggcccggcccgcgtatttgacgacgagcagtcggcgctggccgccatcctggccggcaagatcaaggcgggcgacgtgatggtgctgcgttacctcggccccaagggcggtcccggcatgcctgaaatgctggcgcctaccggtgcgctgattggcgccggcctgggcgaaagcgtgggcctgatcaccgacggccgcttctccggcggcacctggggcatggtagtcggccatgtggcccccgaagcggccgccggcggcaatatcgcattcatcaacgaaggcgactccatcaccattgactcaaaacagttgctgctgcaactgaacatcagcgacgcggagctggaaaaacgcaaggtcggctggaaagcaccggcaccgcgctacaaccgcggcgtgcaggccaagtttgccttcaacgcgtcgagtgccagcaagggtgcggtgctggacgactattga

SEQ ID NO: 360 - protein, 564 aa, Polaromonas sp.
METKTIQLNPRSKNITEGKSRAPNRSMYYAMGYEEADFKKPMIGVANGHSTITPCNSGLQKLADAAIAGIEEAGGNAQVFGTPTISDGMAMGTEGMKYSLVSREVISDCIETCVQGQWMDGVLVIGGCDKNMPGGLMGMLRANVPAIYVYGGTILPGSYKGKDLNIVSVFEAVGENAAGRMSDEDLLQIERRAIPGTGSCGGMYTANTMSSAFEALGISLPYSSTMANPHDEKMNSARESAKVLVEAIKKDIKPRDLVTKKAIENAVAVIMATGGSTNAVLHFLAIAHAAGVDWTIDDFERVRQRTPVLCDLKPSGKYLAVDLHRAGGIPQVMKMLLAAGLLHGDCLTITGQTIAEVLKDVPEAPRADQDVIRPISNPMYAQGHLAILKGNLSPEGCVAKITGLKNPVMTGPARVFDDEQSALAAILAGKIKAGDVMVLRYLGPKGGPGMPEMLAPTGALIGAGLGESVGLITDGRFSGGTWGMVVGHVAPEAAAGGNIAFINEGDSITIDSKQLLLQLNISDAELEKRKVGWKAPAPRYNRGVQAKFAFNASSASKGAVLDDY

SEQ ID NO: 361 - DNA, 1695 bp, Polaromonas naphthalenivorans
atggaaaccaaagtcatcgccatcaaccgccgctcggccaacatcaccgagggcaagtcgcgcgcgcccaaccgctccatgtactacgccatgggctacgaggaaagcgatttcaagaaacccatgatcggcgtggccaacggccacagcaccatcacgccgtgcaacagcggcctgcaaaagctggcggacgcggcgattgacgcgattgaggaagccggcggcaatgcgcaggtgttcggcacgccgacgatttcggacggcatggccatgggcaccgaaggcatgaagtattcgctggtcagccgcgaagtcatttcggactgcatcgaaacctgcgtgcagggccagtggatggacggcgtgctggtggtcggcggctgcgacaagaacatgcccggcggcctgatgggcatgctgcgcgccaacgtgccggcgatttttgtctatggcggcacgatcttgccaggccattaccagggcaaagacctgaacatcgtcagcgtgttcgaagccgtcggtgaaaacgccgccggccgcatgagcgacgaagacctgctgcagattgagcgtcgcgccattcccggcaccggcagctgcggcggcatgtacaccgccaacaccatgtccagcgccttcgaggccctgggcatttcgctgccctactccagcaccatggccaatccgcatgacgaaaagctgaactcggcgaaggaatcggcccgggtgctgatcgaagcggtcaagaaagacatcaagccgcgcgacatcgtcaccaagaaatccattgaaaacgccgtggccgtcatcatggccaccggcggctcgaccaatgccgtgctgcatttcctggccatcgcccatgcggccggcgtcgaatggacgattgacgacttcgagcgcgtgcgccagaaaaccccggtgctgtgcaacctgaaaccctcgggccagtacctggcggtggacctgcaccaggccggcggcattccgcaggtcatgaaaatgctgctggtcgccggcctgctgcatggcgactgcatcaccatttcgggccagaccattgccgaagtgcttgcggacgtgcccgatgcgccgcgcgccggccaggacgtgatccgccccatcgaccagccgatgtatgcgcagggccacctggccatcctcaagggcaacctctcgcccgaaggctgcgtggccaagatcaccggcttgaagaacccggtcatgaccggcccggcccgggtgtttgaggacgagcagtccggcctgaaggcgattctggacggcaagatcgtggccggtgacgtgatggtgctgcgctacctcggccccaagggcggtcccggcatgcctgaaatgctggccccgaccggcgcgctgattggcgccggcctgggcgagagcgtcggcctgatcaccgacgggcgcttttccggcggcacctggggcatggtggtcggccatgtggcgccggaagcggcggccggcggcaatatcgccttcatcgaggaaggcgactcgatcacgattgacgccaatcagctgctgctgcaactgaacatcagcgacgccgagcttgaaagccgcaaggtcggctggacggccccggccccgcgttacacccgtggcgtgcaggccaagttcgccttcaatgcctccagcgccagcaagggcgcggtgcttgatgactattga

SEQ ID NO: 362 - protein, 564 aa, Polaromonas naphthalenivorans
METKVIAINRRSANITEGKSRAPNRSMYYAMGYEESDFKKPMIGVANGHSTITPCNSGLQKLADAAIDAIEEAGGNAQVFGTPTISDGMAMGTEGMKYSLVSREVISDCIETCVQGQWMDGVLVVGGCDKNMPGGLMGMLRANVPAIFVYGGTILPGHYQGKDLNIVSVFEAVGENAAGRMSDEDLLQIERRAIPGTGSCGGMYTANTMSSAFEALGISLPYSSTMANPHDEKLNSAKESARVLIEAVKKDIKPRDIVTKKSIENAVAVIMATGGSTNAVLHFLAIAHAAGVEWTIDDFERVRQKTPVLCNLKPSGQYLAVDLHQAGGIPQVMKMLLVAGLLHGDCITISGQTIAEVLADVPDAPRAGQDVIRPIDQPMYAQGHLAILKGNLSPEGCVAKITGLKNPVMTGPARVFEDEQSGLKAILDGKIVAGDVMVLRYLGPKGGPGMPEMLAPTGALIGAGLGESVGLITDGRFSGGTWGMVVGHVAPEAAAGGNIAFIEEGDSITIDANQLLLQLNISDAELESRKVGWTAPAPRYTRGVQAKFAFNASSASKGAVLDDY

SEQ ID NO: 363 - DNA, 1695 bp, Rhodoferax ferrireducens
atggacatcaaaccagtcatcctgaacccacgcagcaaaaacatcaccgagggcaaatcgcgggcgcccaatcgctccatgtactacgccatgggctacgaggccgacgacttcaagaagcccatgatcggtgtcgccaacggccacagcaccatcacaccgtgcaactccggcctgcaaaagctggccgatgccgccattgccgcgattgaagaagccggcggcaacgcccaggtgttcggcacccccaccatttccgacggcatgtcgatgggcaccgagggcatgaagtattcgctggtcagccgcgaagtaatttccgactgtattgagacctgcgtgcagggccagtggatggacggtgtgctggtgatcggcggttgcgacaaaaacatgcccggcggcctgatgggcatgctgcgcgccaatgtgcccgcgatttatgtctacggcggcaccattttgccgggccattacaagggccaggacctcaacatcgtgagcgtgttcgaggccgtgggcgagaacgccgcaggtcgcatgagcgacgaagatctgttggagattgagcgccgcgccatccctggccccggctcttgcggcggcatgtacaccgccaacaccatgagttcggcctttgaggcactgggcatctccctggtctactcgtccaccatggccaatccgcatgacgagaagctgaattcggcccaagaatcagccaaggtgctgattgaagccatcaagaacgacctgaagccgcgtgacatcgtgacccgcaaatcgattgagaacgcgattgccgttgtgatggcgattggcggctcgaccaacgcggtgctgcatttcctggcgattgcccatgccgcaggcgtggagtggacgattgacgactttgagcgtgtacgccaaaaaaccccggtgttgtgcgacctcaaaccgagcggcaagtacctggcggtggacctgcaccgcgccggtggcattccgcaagtgatgaagatgctgctaagcgctggcctgctgcacggcgactgcatcaccatcaccggccagaccgtggctgaagtgttgaaagacgtgccggatgcaccacgggcagaccaaaacgtgattcggccgatgaacaaaccgatgtatgcccagggccatctggccattctgaagggcaacctggccccggaaggctgcgtcgccaagatcaccggcctgaaaaacccggtcatgaccggcccggcacgcgtctttgaggacgaacaatcggccttggccgcgattctggccaacaagattgtggccggcgatgtcatggtgctgcgctacctcggccccaaaggcggccccggcatgcccgaaatgctggccccgaccggcgcgctggtcggccagggtttgggcgaatcagtcggcctgatcaccgacggccgtttctccggtggcacctggggcatggtggtcggtcacgtggcaccggaagcggctgccggcggcctgattgctttgattgaagaaggcgactcgatcaccatcgacgcgcaccagttgctgctgcaactcaacgtcagcgacgacatcattgccaaacgccgtagcgtgtggacggccccgcagccgcgctacacacgcggcgtgcaggccaagtttgcctttaacgcatccaccgccagcaagggtgcggtgctggacaactactga

SEQ ID NO: 364 - protein, 564 aa, Rhodoferax ferrireducens
MDIKPVILNPRSKNITEGKSRAPNRSMYYAMGYEADDFKKPMIGVANGHSTITPCNSGLQKLADAAIAAIEEAGGNAQVFGTPTISDGMSMGTEGMKYSLVSREVISDCIETCVQGQWMDGVLVIGGCDKNMPGGLMGMLRANVPAIYVYGGTILPGHYKGQDLNIVSVFEAVGENAAGRMSDEDLLEIERRAIPGPGSCGGMYTANTMSSAFEALGISLVYSSTMANPHDEKLNSAQESAKVLIEAIKNDLKPRDIVTRKSIENAIAVVMAIGGSTNAVLHFLAIAHAAGVEWTIDDFERVRQKTPVLCDLKPSGKYLAVDLHRAGGIPQVMKMLLSAGLLHGDCITITGQTVAEVLKDVPDAPRADQNVIRPMNKPMYAQGHLAILKGNLAPEGCVAKITGLKNPVMTGPARVFEDEQSALAAILANKIVAGDVMVLRYLGPKGGPGMPEMLAPTGALVGQGLGESVGLITDGRFSGGTWGMVVGHVAPEAAAGGLIALIEEGDSITIDAHQLLLQLNVSDDIIAKRRSVWTAPQPRYTRGVQAKFAFNASTASKGAVLDNY

SEQ ID NO: 365 - DNA, 1707 bp, Verminephrobacter eiseniae
atggcagacaacaagacgaccacgatcgagcctatcaaccgccgcagcgcgaacatcacacagggcaagtcgcgcgcacccaaccgctccatgtactacgccatgggctacgtggagggcgacttcgtcaagccgatggtcggcgtggccaatggccacagcaccatcacgccttgcaacagcgggctgcaaaaactgaccgatgccgccatcgagggcatcgaggaggccggcggcaatgcccaggtgttcggcacgccgaccatctcggacggcatggccatgggcaccgaaggcatgaagtacagcctggtcagccgtgaagtcatcagcgactgcatagaaacctgcgtcagcggccagtggctggacggcgtgctggtggtcggcggctgcgacaaaaacatgcccggcggcctgatgggcatgttgcgcgccaacgtgcccgcaatctatgtgtacggcggcaccatcctgcccggccactaccaggggcgggaactgaatatcgtcagcgtgttcgaggcggtgggcgaaaacgccgccggcaagctgagcgaccacgacctcagggagatcgaaaagcgcgccatccccggcaccggctcctgcggcggcatgtataccgccaacaccatgtccagcgcgttcgaggccctgggcatcagcctgccctactcgtcgaccatggccaacccgcatgacgagaagacgaactcggccaaggcatcggccaaggtgctgatcgaggccatccgcaacgacctcaagccgcgcgacatcgtgaccaggaaggccatcgagaatgcagtggccgtgatcatggccaccggcggctcgaccaacgccgtgctgcatttcctggcgatcgcccatgcggcaggcgtgccgtggagcatcgacgacttcgagcgcgtgcgccagaagacccccgtgctgtgcgacctcaagcccagcggcaaatacctggccgtggacctgcaccgcgcgggcggcatcccgcaggtgatgaagctgctgctcaacgccggcctgctgcatggcgactgcatcaccatcgagggcaagacgatggcccaagtgctcaaggatgtgcccgatcggccgcgcgcagaccagaacgtgatccgccccatcgaccagcccctgtacgcgcagggccacctggccatcctcaagggcaacctcagccccgaaggggccgtggccaagatcaccggcctgaagaacccggtcatcaccggcccggcgcgcgtgttcgacgacgagcaatctgcgctgcaggcgatactggacggcaagatccaggccggcgacgtgatggtgctgcgctacctggggcccaagggcggccccggcatgcctgaaatgctggcccccaccggcgcgctgatcggcgccggcctgggagaaagcgtgggcctgatcaccgacgggcgcttttccggcggcacctggggcatggtcgtcggccatgtggcgcccgaggccgccgcaggcggcaccatcgctttcgtgcatgaaggcgacagcatcaccatcgacgcccgccaactgctgctgcaattgaatgtggctgaggcagaaatcgcccggcgccgtgcccggtggacggcccccgctgcgcgctacacacgcggcgtgcaggccaagttcgccttcaacgcatcgagcgccagccaaggcgcggtgctcgacgcatactga

SEQ ID NO: 366 - protein, 568 aa, Verminephrobacter eiseniae
MADNKTTTIEPINRRSANITQGKSRAPNRSMYYAMGYVEGDFVKPMVGVANGHSTITPCNSGLQKLTDAAIEGIEEAGGNAQVFGTPTISDGMAMGTEGMKYSLVSREVISDCIETCVSGQWLDGVLVVGGCDKNMPGGLMGMLRANVPAIYVYGGTILPGHYQGRELNIVSVFEAVGENAAGKLSDHDLREIEKRAIPGTGSCGGMYTANTMSSAFEALGISLPYSSTMANPHDEKTNSAKASAKVLIEAIRNDLKPRDIVTRKAIENAVAVIMATGGSTNAVLHFLAIAHAAGVPWSIDDFERVRQKTPVLCDLKPSGKYLAVDLHRAGGIPQVMKLLLNAGLLHGDCITIEGKTMAQVLKDVPDRPRADQNVIRPIDQPLYAQGHLAILKGNLSPEGAVAKITGLKNPVITGPARVFDDEQSALQAILDGKIQAGDVMVLRYLGPKGGPGMPEMLAPTGALIGAGLGESVGLITDGRFSGGTWGMVVGHVAPEAAAGGTIAFVHEGDSITIDARQLLLQLNVAEAEIARRRARWTAPAARYTRGVQAKFAFNASSASQGAVLDAY

SEQ ID NO: 367 - DNA, 1695 bp, Acidovorax sp.
atgaccgacccgctgccgctgaaccgccgctccgcccacatcacccagggcaaggcgcgcgcgcccaaccgctccatgttctacggcatgggctaccaagagggtgacttcgccaagcccatggtgggcgtggccaacgggcacagcaccatcacgccctgcaacagcggcctgcaacgcctggccgacgcggccatcgcaggcatcgaggaagcgggcggcaacgcccaggtcttcggcacgcccaccatcagcgacggcatggccatgggtaccgagggcatgaagtacagcctggtgagccgcgaggtgattgccgactgcgtcgagacctgcgtgcagggccagtggatggacggcgtggtcgtcatcggcggctgcgacaagaacatgcccggcggcctgatgggcatgctgcgcgccaacgtgccggccatctacgtgtatggcggcaccatcctgccgggccgctggcaggggcaagacctgaacatcgtgagcgtgttcgaagccgtgggccagaacgccgcgggcaggatgaccgaccaggagctgaaggacatcgagcagcacgccatcccgggcacgggctcgtgcggcggcatgtacacggccaacaccatgtcctcggccttcgaggcgctgggcatgagcctgccctactcctccaccatggccaatccgcacgacgagaaaatgaactcggcccgcgaatccgcccgggtgctgatcgaggccatccgcaaggacttgaagccacgcgacatcgtcacgcgcaaggccatcgagaacgccgtggccgtgatcatggccacgggcggctccaccaacgcggtgctgcacttcctggcgatcgcgcacgcggcgggtgtggagtggtccatcgacgacttcgagcgcatgcgcaagaaggtcccagtgatctgcgacctcaagcccagcggccggtacctggccgtcgacctgcaccgcgcgggcggcattccccaggtgatgaaggtgctgctgaacgccggcctgttgcacggcgactgcatgaccatcaccggtaaaaccatcgccgaaaccctggccgacgtacccgacgcgccacggccggaccaggacgtgattcgcccgatcgacaaggcgctgtaccgcgaggggcacctcgccatcctcaagggcaacctgagtcccgagggcgccgtggccaagatcaccgggctgaagaaccccgtcatcaccgggcccgcgcgtgtgttcgacgacgagcagtcggcgctgcaggccatcctggacggcaggatcgtcgcgggcgacgtgatggtgttgcgctacctcggccccaagggtggcccgggcatgccggagatgctggcccccacgggcgcgctgatcggtgcgggcctgggcgagagcgtgggcctgatcaccgacgggcgcttctcgggcggcacctggggcatggtggtgggccacgtcgcgcccgaggccgctgcggggggcactattgcgctggtgcatgagggcgacacgatcaccatcgacgcccaccaactgctgctgcaactgcacgtggacgacgccacgctggcacagcgccgcgccgcctggcagccacccacgccgcgctacatgcggggcgtgcaggccaagtttgccttcaacgcctccagcgccagcaagggtgcggtgctggatgacttttcatga

SEQ ID NO: 368 - protein, 564 aa, Acidovorax sp.
MTDPLPLNRRSAHITQGKARAPNRSMFYGMGYQEGDFAKPMVGVANGHSTITPCNSGLQRLADAAIAGIEEAGGNAQVFGTPTISDGMAMGTEGMKYSLVSREVIADCVETCVQGQWMDGVVVIGGCDKNMPGGLMGMLRANVPAIYVYGGTILPGRWQGQDLNIVSVFEAVGQNAAGRMTDQELKDIEQHAIPGTGSCGGMYTANTMSSAFEALGMSLPYSSTMANPHDEKMNSARESARVLIEAIRKDLKPRDIVTRKAIENAVAVIMATGGSTNAVLHFLAIAHAAGVEWSIDDFERMRKKVPVICDLKPSGRYLAVDLHRAGGIPQVMKVLLNAGLLHGDCMTITGKTIAETLADVPDAPRPDQDVIRPIDKALYREGHLAILKGNLSPEGAVAKITGLKNPVITGPARVFDDEQSALQAILDGRIVAGDVMVLRYLGPKGGPGMPEMLAPTGALIGAGLGESVGLITDGRFSGGTWGMVVGHVAPEAAAGGTIALVHEGDTITIDAHQLLLQLHVDDATLAQRRAAWQPPTPRYMRGVQAKFAFNASSASKGAVLDDFS

SEQ ID NO: 369 - DNA, 1695 bp, Delftia acidovorans
atgaccccgccgaaccagatcaaccgccgaagctcccacatcaccgaaggcaaggcgcgcgcagccaaccgctccatgttctacggcatgggctacaaggaagaggatttcaagaagcccatggtcggcgtggccaacggccacagcacgatcacgccgtgcaactccggcctgcaaaggctggcggacgcggccatcgcaggcatcgaggaagccggcggcaacgcgcaggtgttcggcacgccgaccatctcggacggcatgtccatgggcacggaaggcatgaagtactcgctggtcagccgcgaggtgatcgccgactgcatagagacctgcgtgggcggccagtggatggacggcgtgctagtggtcggcggctgcgacaagaacatgccgggcggcatgatgggcatgctgcgcgccaatgtgccggccatctacgtctacggcggcaccatcctgcccggcaggtggaaaggccgggacctgaacatcgtcagcgtgttcgaggccgtcggcgaaaacgccgcgggaaagatcagcgaccaggagctcaaggacatcgagcagcacgccattcccggcacgggctcgtgcggcggcatgtacaccgccaacaccatgtcgagcgcgttcgaggcgctgggcatgagcctgccctactcctccaccatggccaatccccatgatgaaaaggaaaactcggccaaggaatccgccagggtgctgatcgaggccatcaagatggacctcaagccgcgcgatatcgtgacgcgcaagtccatcgagaacgcggtctcggtgatcatggcgaccgggggctccaccaatgccgtgctgcactttcttgcgatcgcccatgcggccggcgtgccctggtccatcgacgacttcgagcgcatccgccagcgggtgccggtgctgtgcgatctcaagcccagcggcagatacctggcggtggacctgcaccaggcgggcggcatcccgcaggtcatgaagatcctgctgaatgcgggcctgctgcacggcgactgcatcaccatctcgggccagaccattgcgcagaccctggctggcgtgcctgacgaaccaccgaacccgcagatcatccgccccctctcggatgcactctatccgcagggccacctggccattctcaagggcaacctgagcccggaaggcgcggtggccaagatcacgggcctgaagaacccggtcatcaccggcccggcacgcgtgttcgacgatgagcaatcggcactggcggccatcctcgacggcaggatacaggccggcgatgtgatggtgctgcgctacctgggccccaagggcggccccggcatgccggaaatgctggcccccacgggcgccctgatcggcgccggcctgggcgagagcgtgggcctgatcaccgatggccgcttctccggcggcacctggggcatggtggtcggccacgtggcgccggaagcggccgtgggcggcaccatcgcgctggtgcacgagggcgactcgatcaccatcgacgcgcacgcattgcggctgcagctgaacgtgcccgaagacgtgctcgcccagcgccgcgcggcatggaaggcccccgcgccccgctacacgcggggcgtgcaggccaagttcgctttcaacgcatcgagcgccagctcgggcgcggtgctggacaacttcgccatctga

SEQ ID NO: 370 - protein, 564 aa, Delftia acidovorans
MTPPNQINRRSSHITEGKARAANRSMFYGMGYKEEDFKKPMVGVANGHSTITPCNSGLQRLADAAIAGIEEAGGNAQVFGTPTISDGMSMGTEGMKYSLVSREVIADCIETCVGGQWMDGVLVVGGCDKNMPGGMMGMLRANVPAIYVYGGTILPGRWKGRDLNIVSVFEAVGENAAGKISDQELKDIEQHAIPGTGSCGGMYTANTMSSAFEALGMSLPYSSTMANPHDEKENSAKESARVLIEAIKMDLKPRDIVTRKSIENAVSVIMATGGSTNAVLHFLAIAHAAGVPWSIDDFERIRQRVPVLCDLKPSGRYLAVDLHQAGGIPQVMKILLNAGLLHGDCITISGQTIAQTLAGVPDEPPNPQIIRPLSDALYPQGHLAILKGNLSPEGAVAKITGLKNPVITGPARVFDDEQSALAAILDGRIQAGDVMVLRYLGPKGGPGMPEMLAPTGALIGAGLGESVGLITDGRFSGGTWGMVVGHVAPEAAVGGTIALVHEGDSITIDAHALRLQLNVPEDVLAQRRAAWKAPAPRYTRGVQAKFAFNASSASSGAVLDNFAI

SEQ ID NO: 371 - DNA, 1683 bp, Methylibium petroleiphilum
atgagcatcaaccgccgttcgaagaacatcaccgaaggcgtggcccgcgcacccaaccgctcgatgtactacgcgatgggctaccaggaggccgacttcaagaagccgatgatcggcgtggcgaacggccactcgaccatcacgccctgcaactcgggcctgcagaagctggccgacgccgcggtcgagggcatcgaggcggccggcggcaatgcacagatcttcggcacccccaccatcagcgacggcatggcgatgggcaccgagggcatgaagtactcgctggtctcgcgcgaggtcatcgccgactgcgtggaaacctgcgtcggcggccagtggatggacggcgtgctggtggtcggcggctgcgacaagaacatgccgggcggcatgatgggcatgctgcgcgccaacgtgcccgcgatctacgtctacggcggcaccatcctgccgggaaagtacaagggccaggatctcaacatcgtcagcgtgttcgaggccgtcggccagttcaccgcgggcaacatgagcgaggaagacttctgccagatcgagcgacgcgcgatcccgggcagtggctcctgcgggggcatgtacaccgccaacaccatgagttcggccttcgaggccctgggcatgagcctgccgttcgcctccacgatggccaatgtcgaggacccgatcgtcgcgcacaccaaggaagcggcgcgcgtgctggtcgaggcagtgaaggccgacctcaagccgcgtgacatcgtcacacgcaagagcatcgagaacgcggtcgcggtgatcatggccaccggcggctcgaccaatgcggtgctgcacttcctggccatcgcgcacgccgccggcgtcgagtggacgatcgacgacttcgagcgcgtgcgccgcaaggtgccggtgctgtgcgacctcaaacccagcggcaggtacctggcgatcgacctgcaccgcgccggcggcatcccgcaggtgatgaagacgctgctcgccgccgggctgatccacggcgactgcatcaccatcaccggaaggaccgtggccgagaacctggccgacatccccgatgcgccgcgcgccgaccaggacgtgatccgcccgatcacgaagccgatgtacgagcaaggccacctggccatcctgaagggcaacctgtcgcctgagggcgccgtggccaagatcaccggcctgaagaatcccagcatcactggcccggcgcgcgtgttcgacgacgagcagtcggcgctggccgccatcatggccaagcagatccaggccggcgacgtgatggtgctgcgctacctgggcccgatggggggcccgggcatgcccgagatgctggcgccgaccggtgcgctgatcggccaagggctgggcgaatcggtggggctcatcaccgacggccgcttctccggcggcacctggggcatggtggtcggccacgtggcacctgaggccgcggccggcggcacgatcgcgctggtgcaggaaggcgactcgatcaccatcgatgcgcacacgctggtgctcaacctcaacgtgagcgaggccgagatcgcaaagcgtcgcgccgcctggaaggcaccggcgccgcgctacacacgcggcgtgctggccaagttcgcgaagaacgcgtcaagcgccagcagcggcgcggtattggaccgcttcgagtag

SEQ ID NO: 372 - protein, 560 aa, Methylibium petroleiphilum
MSINRRSKNITEGVARAPNRSMYYAMGYQEADFKKPMIGVANGHSTITPCNSGLQKLADAAVEGIEAAGGNAQIFGTPTISDGMAMGTEGMKYSLVSREVIADCVETCVGGQWMDGVLVVGGCDKNMPGGMMGMLRANVPAIYVYGGTILPGKYKGQDLNIVSVFEAVGQFTAGNMSEEDFCQIERRAIPGSGSCGGMYTANTMSSAFEALGMSLPFASTMANVEDPIVAHTKEAARVLVEAVKADLKPRDIVTRKSIENAVAVIMATGGSTNAVLHFLAIAHAAGVEWTIDDFERVRRKVPVLCDLKPSGRYLAIDLHRAGGIPQVMKTLLAAGLIHGDCITITGRTVAENLADIPDAPRADQDVIRPITKPMYEQGHLAILKGNLSPEGAVAKITGLKNPSITGPARVFDDEQSALAAIMAKQIQAGDVMVLRYLGPMGGPGMPEMLAPTGALIGQGLGESVGLITDGRFSGGTWGMVVGHVAPEAAAGGTIALVQEGDSITIDAHTLVLNLNVSEAEIAKRRAAWKAPAPRYTRGVLAKFAKNASSASSGAVLDRFE

SEQ ID NO: 373 - DNA, 1683 bp, unknown
  gamma proteobacterium KT 71
atggcgctcaatcgtcgctccaaaaacatcaccgagggcgtccaacgtgcgcccaatcgctccatgtactacggcatgggctatgaggagggcgattttaggaagcccatggtgggcattgccaactctcactcgacgatcacgccctgtaatgcgggactccagcccctggctgatgccgctcaggaaggcctgaaagaagccggggccaatcctcaggtgtttggcacgccgaccatatccgacggcatgtccatgggtaccgagggcatgaagtactccctggtatcccgggaagttatcgctgactgcatcgaaacctgcgtgggcggtcagtggatggacggcgtgctggtgatcggtggctgtgacaaaaacatgcccggcggcatgatgggcatgctccgcgcaaacgtcccctcgatttttgtatacggcgggaccattcttcccgggcgtcacaatggtcaggatctgaacatcgtcagcgtgtttgaggcggtcggtgagcatgcggcggggcgtatcagggacgaggatttactggctatcgaacgcaatgcgattccgggaacgggctcctgcggcggtatgtataccgcaaacaccatgagctcggcctttgaggccctgggcatgagccttccttattcctcgaccatggcaaacgtcgagtccgaaatcaaagaatcagccaaggcgagcgcgctggctctggtggaggcgattcgcctggatcttaagcccagggatattgtgacccgcgagtccctggaaaatgccgttgcggtgattatggcgaccgggggatcgaccaatgcggtattacactttctggcgattgcccacgccgcggagattgactggagtatcgacgactttgagcgaatccgacaaaaagtaccggtgctctgcgatctcaagcccagcggggagtatctggccattgatctgcaccgtgctggcggcattccccaggtgatgaaaattctcttggacgggggcttgctccacggcgactgcatgaccgtaacgggcaagactattgcggaatccctggcggatgtgccttcgacgcccgtggaccccaaggtcattcgtcctctggataaccccatgtatgccaaggggcatctggcgattcttcgcggcaatctcgccgaagagggcgccgtagccaaaatcacgggtctgaaaaaccccgtgatcacgggacctgcgaaagtgtttgatgatgaacagtcggcccttgatgccattctcgcgggcaaggtcaaagccggtgacgtggtggtactgcggtatctagggccccagggcggaccgggtatgcccgagatgctggcacccaccagtgctctggtggggcagggtctcggggagtccgtaggcctgattaccgacggccgattttccgggggcacctgggggatggttgtggggcatgtggcacccgaagcctatgcgggtggtctcattgccctgatagaggagggggactccatcaccatcgatgcccataccctgagtctggaactcaatgtcgacgacaaagaaattgctcgccggcgcggcgcctgggtaaagcccgagccacgctacacccggggcgtcctcgccaagtttgcaaaaaatgcagccaccgcaagccgcggcgcggtgctggatctgtatgaggactaa

SEQ ID NO: 374 - protein, 560 aa, unknown
  gamma proteobacterium KT 71
MALNRRSKNITEGVQRAPNRSMYYGMGYEEGDFRKPMVGIANSHSTITPCNAGLQPLADAAQEGLKEAGANPQVFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIRDEDLLAIERNAIPGTGSCGGMYTANTMSSAFEALGMSLPYSSTMANVESEIKESAKASALALVEAIRLDLKPRDIVTRESLENAVAVIMATGGSTNAVLHFLAIAHAAEIDWSIDDFERIRQKVPVLCDLKPSGEYLAIDLHRAGGIPQVMKILLDGGLLHGDCMTVTGKTIAESLADVPSTPVDPKVIRPLDNPMYAKGHLAILRGNLAEEGAVAKITGLKNPVITGPAKVFDDEQSALDAILAGKVKAGDVVVLRYLGPQGGPGMPEMLAPTSALVGQGLGESVGLITDGRFSGGTWGMVVGHVAPEAYAGGLIALIEEGDSITIDAHTLSLELNVDDKEIARRRGAWVKPEPRYTRGVLAKFAKNAATASRGAVLDLYED

SEQ ID NO: 375 - DNA, 1665 bp, Tremblaya princeps
atgaacacgaactcaagacgcataacgcatggattcaccaggtctccgaacagggccatgctctgtgccatggggtacgatggcgcagactttgccaagcccatcataggcgtaggaagcggttactccaccataacaccgtgcaatgctggcatacagcgcgtcgtcgatgcggcgaaagccatgctggcaaggcatggagccatgacgcaggttttcggcatccctaccatatccgacggcatatcaatgggcacgccgggcatgaggtactctctcgtgtctcgtgaggtgatcgctgattgtatagaggcatgtgcttgtgggcagagcatggacgggctgctagtcgtagggggctgcgataagaacctgcctggtggcatgatcgggctactacgagccaacatcccagggatttacctgtatggcggcacaatactgccagggtactggggcgccagggagctgactgtggtgagttcattcgaggcagttggcgccatgggtaggcagggcatgtctatagacgctatgcgtgaagtggagcgacacgcctgccccactacaggctcgtgcggcgggatgtacacagcaaacacaatgagcgcatcatttgaggcccttggcatgtccctgctctactcgtccactgctccgagcccaggcatcgagggtgagctatccatctcaacgtcggcacggtctctgatcaacgcagtgcgacggggcataaggccaagggacgtggtaactcacaggtccattcgcaatgccatggcggttgtaatggcagtcggcgggtctacaaacgccgtgctgcactacctggcgatagccgctgcagctcgttctgctctctcactgcacgacgttgagctaataaggaggagggtgcctgtaatatgtaacatgaagccctctggactgcatagcactgcagacctacattcagcaggcggcgttcctcgtgttatgcacgagcttgcgctcgctggtctcattgacgagtcgtgcctcacgataacgggcagaacgataggtgcagagctcctcgcggcgcaccgcaagcgccatggctctaccgttgtgctgcctactaacatggcgttataccgtacaggacgccttgttgtgctgagcggtaatatgtcaaggaacggcgcagttgccaagacttcaggccttagcatactattgcacagcggcactgccagagtgtttcgcagcgaggaggcctgtgttcaggctatactcaacggctgcgtgcgcattggcgacgtagttgtgctgatttacctaggcccaaagggagggcctggcatgcctgagatgctatccccaactgcagcgctagttggcatgggactaggccagtccgcttgcctcattacagatggtaggttctctggaggaacgtggggcctggtggtcgggcatgtatcacccgaggcagccgtgggtggctccatagcgcttgtccgtaacggcgacttcatcacagtagacctgcgcaacaactctcttcacctgcatatagacgcatggtcgcttgctgcacggcgtgcagcatggcggctaccttgcactttgtgtgtagagggactactgagaaagtaccacgatggagttggccagtctcacaatggcgccatcgctgcatag

SEQ ID NO: 376 - protein, 554 aa, Tremblaya princeps
MNTNSRRITHGFTRSPNRAMLCAMGYDGADFAKPIIGVGSGYSTITPCNAGIQRVVDAAKAMLARHGAMTQVFGIPTISDGISMGTPGMRYSLVSREVIADCIEACACGQSMDGLLVVGGCDKNLPGGMIGLLRANIPGIYLYGGTILPGYWGARELTVVSSFEAVGAMGRQGMSIDAMREVERHACPTTGSCGGMYTANTMSASFEALGMSLLYSSTAPSPGIEGELSISTSARSLINAVRRGIRPRDVVTHRSIRNAMAVVMAVGGSTNAVLHYLAIAAAARSALSLHDVELIRRRVPVICNMKPSGLHSTADLHSAGGVPRVMHELALAGLIDESCLTITGRTIGAELLAAHRKRHGSTVVLPTNMALYRTGRLVVLSGNMSRNGAVAKTSGLSILLHSGTARVFRSEEACVQAILNGCVRIGDVVVLIYLGPKGGPGMPEMLSPTAALVGMGLGQSACLITDGRFSGGTWGLVVGHVSPEAAVGGSIALVRNGDFITVDLRNNSLHLHIDAWSLAARRAAWRLPCTLCVEGLLRKYHDGVGQSHNGAIAA

SEQ ID NO: 377 - DNA, 1689 bp, Blastopirellula marina
atgtctcagcccctcaattggaatagtcgccgtttaacgcgtggatggcaaaaagggatcaccgctttttattacggcttgggactgaccgacgccgattttgacaaaccgcagatcgggatcggcgtgccgctgctggacggcaatctttgcaacgtccacgcctatcaactgggccaagagctgaaagcaggctgcgagcaagcgggactgatcgggtttccgtttggcacgccggccgttagcgataacatcacgcaaggacatgaagggggcaacgccagccttccctcgcgtaatatgatcgccaatgcggctgaatgcgtcgtcagcgcccatggctacgactttttgatcggactgcacaattgcgacaaaaacgggcccggcttcgccatggcgttggctcggctcaactatcccgggctgatcgtcaacggcggcagtattaaacctggttgccatctgggccgcgacacgtcgatcttggatgtctacgacgcccaagcggcggcttccgtgggcgcaatgacggcggacgaagcggatcagatcttgcgaaccgcttgtcccggacccggcgggtgcggcatcgccgcttcttttaatacttggggaatcgcgatcgaagcgatcgggctagggcttccctactccagttcgatcccggctgaagatccggccaaacgcgaagaatgccgcagcatcggccaagcagtcaagcatctgctgaccgagaacattcgcccccgcgatattttgaccaaaaaggcgtttgaaaacgcagccgcggtgatcgccgccgtgggcggctcgaccaacggcgtgctgcacctgatcgcgctggccaaagaagccgaagttgatttcacattgcgtgacgtgcagcggattgtccgcaacacgccggtcctgtgcagcttcgctccgcgcggcaaacgcacgatgtacgacctgcacaagctggggggtacgccgatgctgctgaagtacttgatctcggtcggcattgtcgatggttcgtgcctgaccgtctcgggcaagtcattggccgaaaacgtcaacggcgcggccgatgttcccgcggatcaagacttgatcgcgacgatcgaaaagccgttcaaagaatatgccgacatgcagatctgctttggcaacctggcgcccggcggcgtggtcttcaaagtatcgagcatgcgtgacccaaaattcagcggcaaagcgatctgcttttcggaagccaaggatatcgtcaacgcggtcgaagcgaataagatcacgccgggaaccgtgatcgtgcttcgttatctggggccggtcgcttcggggatgccggaagtgttggtcgcgaccgcggctttggccgtaccgcatctggacggcaaagtagcgtttctgtcagacacgcgcgtctctggcgtatcgcacggagcgatcggcgttcactgtgctccggaagcggcagtcggcgggccgatcgcgttggtggaagacggggatgaaatctcgtttgatctgctcggcggcgagatcacgctgcacgtcggagcagacgtgttggcgactcgcgccgccaactggaagacgcctgacctgcggcacaaacatgcctatctggccgacttcgccgcaaccgtctcgcaagccgatagcggttgcgtcagcaaagcgtttcacgacgtctcgtaa

SEQ ID NO: 378 - protein, 562 aa, Blastopirellula marina
MSQPLNWNSRRLTRGWQKGITAFYYGLGLTDADFDKPQIGIGVPLLDGNLCNVHAYQLGQELKAGCEQAGLIGFPFGTPAVSDNITQGHEGGNASLPSRNMIANAAECVVSAHGYDFLIGLHNCDKNGPGFAMALARLNYPGLIVNGGSIKPGCHLGRDTSILDVYDAQAAASVGAMTADEADQILRTACPGPGGCGIAASFNTWGIAIEAIGLGLPYSSSIPAEDPAKREECRSIGQAVKHLLTENIRPRDILTKKAFENAAAVIAAVGGSTNGVLHLIALAKEAEVDFTLRDVQRIVRNTPVLCSFAPRGKRTMYDLHKLGGTPMLLKYLISVGIVDGSCLTVSGKSLAENVNGAADVPADQDLIATIEKPFKEYADMQICFGNLAPGGVVFKVSSMRDPKFSGKAICFSEAKDIVNAVEANKITPGTVIVLRYLGPVASGMPEVLVATAALAVPHLDGKVAFLSDTRVSGVSHGAIGVHCAPEAAVGGPIALVEDGDEISFDLLGGEITLHVGADVLATRAANWKTPDLRHKHAYLADFAATVSQADSGCVSKAFHDVS

SEQ ID NO: 379 - DNA, 1692 bp, Planctomyces maris
atggatcatcctttaaactggaatagtcaaaacctgacacatggctggcaacggggagtcaccgctttttattacgggttaggcttttcggatcaggatttcgacaaggcccagatcgggattggcgtgccactcttggatggcaacctctgtaatgtgcatgcttacgatcttgcgaaagtaattgcacagggatgtcaatccgctgacatgatcggtcttccttttggagttcccgccgtcagtgacaacatcacccagggacaggaaggaggcaacgccagtctcccctctcggaatatgatcgccaacgcggccgaatgcgtcgtgagtgctcattcgtatgatgccctgattggcctgcataattgcgataaaaacggaccgggcttcgccatggcattggcacgactcaactatccgggactggtcgtcagtggtggcagtatcatgcccggctgccacaaaggacaggacatttcgatcctcgacgtctacgattcccaggcagctgcagcagtcggcgcgatggaagaagaagaagcggaccagattctgaaaaccgcctgcccgggcccggggggatgtggtatcgccgcttctttcaatacctggggcatcgcgctcgaagccatcggccttatgctcccgttcagcagttccacgccggccattgataatgcaaaaaaaacagaatgcctcaatgtcgcctctgccgtgcgaaatctcctgcagaaaaatatccggccgcgcgacatcctgacccgcaaagcatttgaaaatgcagccgccaccatcgcggccgtcggcggctccacgaatggaatcctgcatctgctcgcgctggcacgagaagcggaagtcgaattttacctgcaggacattcaggaaattcttcgaaaaacgcccgtgtattgcagttttgcaccacgcggcaaaaaaaccatggtcgacctgcatcacctgggtggcacaccggtcctcatgaaacacctgctcaaagcaggcatcatcgatggcagttgcctgactgtaaccggcagaaccctggcggaaaacctggcagaaatcggcgatgtccccacgaaccaggaactgatcgcttcgctcgatcaaccgtataaaacttacgccgacatgcagatctgctttggcaatctggcaccgggaggcattgtctttaaagtttccagcatgcaggaatcacatttcacgggaaccgcctgctgcttcgatgaagcgaaaggcgtagtcgatgccgtcgaagcaggtaagatcaaacccggcagtgtcatcgtactacgaaacctgggtccggtcgcatcaggcatgcctgaagtacttgtcgcgactgccgctctgacggtaccggaactggatggcaaagtggcattcatttcggacacacgtgtctccggtgtttcacacggtgccatcggcgtgcattgttctcccgaagcggcagtcggaggtccgattggtctgattcaggatggtgaccagatctcgttcgatctgcttaaaggagaaatcagcgttgatgtctccgaccaggaatttcagcaacgccgagtgaaaaaaccacttcaacccgtcagacattcccgcggctatctggctgatttttcagccaccacctcacaggcacatcatggctgtgtgagtaaagccctgctgccggactgcgaataa

SEQ ID NO: 380 - protein, 563 aa, Planctomyces maris
MDHPLNWNSQNLTHGWQRGVTAFYYGLGFSDQDFDKAQIGIGVPLLDGNLCNVHAYDLAKVIAQGCQSADMIGLPFGVPAVSDNITQGQEGGNASLPSRNMIANAAECVVSAHSYDALIGLHNCDKNGPGFAMALARLNYPGLVVSGGSIMPGCHKGQDISILDVYDSQAAAAVGAMEEEEADQILKTACPGPGGCGIAASFNTWGIALEAIGLMLPFSSSTPAIDNAKKTECLNVASAVRNLLQKNIRPRDILTRKAFENAAATIAAVGGSTNGILHLLALAREAEVEFYLQDIQEILRKTPVYCSFAPRGKKTMVDLHHLGGTPVLMKHLLKAGIIDGSCLTVTGRTLAENLAEIGDVPTNQELIASLDQPYKTYADMQICFGNLAPGGIVFKVSSMQESHFTGTACCFDEAKGVVDAVEAGKIKPGSVIVLRNLGPVASGMPEVLVATAALTVPELDGKVAFISDTRVSGVSHGAIGVHCSPEAAVGGPIGLIQDGDQISFDLLKGEISVDVSDQEFQQRRVKKPLQPVRHSRGYLADFSATTSQAHHGCVSKALLPDCE

SEQ ID NO: 381 - DNA, 1839 bp, Salinibacter ruber
gtgaggctgccgtctttcacgcttcacgtttcacgcatcacgaaaacagcaccttctttcccttccacttttcccttttgcccaatgcccccctcctccgccaacggccactcctccaaaatccagagccaagacgtcaccgagggccttgaccaggcgccggcccgcgcgatgtttcgggcgatgggctacgacgacgccgacctcgaccagcccctcatcggcatcgccaacccggcggcggacgtgacgccctgcaatgtgcacctcgacggccttgccgacgccgcacgcgaaggcgtcactgaggccggcgggacgcccatcgagtttggcaccatcacggttagcgacgggatctcgatgggcacggagggcatgaaggggtccctcatctcccgcgaggtgatcgccgactcggtggaactggtggcctttgccgagcggctcgacgggctcgtcatcatgggcggctgcgacaaaaacatgccgggcatgatgatggcggcgatccgggccgacctcccgagcgtcttcctctacggcgggtccatcatgccgggccaccaccgggggcaggagatcacgatccagaacgtgttcgaggcgtgcggggcggtcgccaccggccagatgagcgaagaggagctcgacgagatggagcgccacgcctgtcccggcgccggcgcctgcggcggcatgttcaccgctaacacaatggcgtccatcagcgaggcgatcggctttgcgccgctggggagcgcgagccccccggcggtgacagaagaacgagaggtggtggcccgcgcggccgggcggcggaccgtcgaggcgatcgaggaacggcggcggccctccgacttcctcagcaagaagtcgttcgagaacgccattgccctccaggtggccgtgggcggctccacgaacggcgtactccacctgctcgcgatggcggcggaggcgggcatcgacctctcgattgaggcgttcgacgcaatcagccggcggacgcccaagatcggcgacttccagcccggcggctcccgcgtgatgaacgacctgcacgaggtcggcggcgtgccggtggtgctgaaggcgcttctcgatgcgggcctgctgcacggcgacgcccagaccgtgacgggggagcccctcgccgaggccctcgaccgcgtcgacccgcccgccatcgcggacctcgacgtggactacctctacacggtggacgaaccgaagaatgaggagggcgccatccgcatcctcaccggcaacctcgcccccgacggcgctgtgctcaaagttacagccgctgatgccccccgctttgagggcacggcccgcgtcttcgagagcgaggaggacgcaatggactacgtgcaggccggccagctcgactcgggcgacgtcattatcattcggaatctcgggcccaagggcgcccccggcatgcccgaaatgcttggcgtgaccgccgcccgggacggacaggggcacgccgacgacgtggccctcatcaccgacgggcgcttctccggggccacccgcggcctctccatcggccacgtcgcccccgaggccgcggccggcgggcccatcgccgccatccaggacggagacccgatcatcatcgacgtggcggagcgtcacctggcggtcgacctgtccgacgccgagctggagcgccgactcgacgaccggtcgcccccggagccccagtacacgaccggcgttctcgccaagtacgccgccctcttcggctccgccgcggagggggcagtgacgagtgtcttttcggatcttcgcgagtcgacatccccctccacggcttcaaatgaatga

SEQ ID NO: 382 - protein, 612 aa, Salinibacter ruber
MRLPSFTLHVSRITKTAPSFPSTFPFCPMPPSSANGHSSKIQSQDVTEGLDQAPARAMFRAMGYDDADLDQPLIGIANPAADVTPCNVHLDGLADAAREGVTEAGGTPIEFGTITVSDGISMGTEGMKGSLISREVIADSVELVAFAERLDGLVIMGGCDKNMPGMMMAAIRADLPSVFLYGGSIMPGHHRGQEITIQNVFEACGAVATGQMSEEELDEMERHACPGAGACGGMFTANTMASISEAIGFAPLGSASPPAVTEEREVVARAAGRRTVEAIEERRRPSDFLSKKSFENAIALQVAVGGSTNGVLHLLAMAAEAGIDLSIEAFDAISRRTPKIGDFQPGGSRVMNDLHEVGGVPVVLKALLDAGLLHGDAQTVTGEPLAEALDRVDPPAIADLDVDYLYTVDEPKNEEGAIRILTGNLAPDGAVLKVTAADAPRFEGTARVFESEEDAMDYVQAGQLDSGDVIIIRNLGPKGAPGMPEMLGVTAARDGQGHADDVALITDGRFSGATRGLSIGHVAPEAAAGGPIAAIQDGDPIIIDVAERHLAVDLSDAELERRLDDRSPPEPQYTTGVLAKYAALFGSAAEGAVTSVFSDLRESTSPSTASNE

SEQ ID NO: 383 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcattgctaacggatttagcaccattaccccctgtaacatgggaattaatgatttagcaatgcgtgccgaagcagccaccagattagcggggggaatgccgcaacttttcgggactatcaccattagtgacgggatttccatgggaacagaaggaatgaaatattctctcgtttctagggaagtaatcgccgattccattgaaaccgtctgtaatggtcaaagtctcgatggagtcctcgctatcgggggttgtgacaaaaatatgccgggagcaatgattgccatggcccggatgaatattcccgctattttcgtctatggtggcacaattaaaccgggacgctacaaagattgcgatttaaccgtggtcagttcctttgaagccgtgggacagtacagcgccggtaaaatcagcgaagaagacctcatcgggattgaacgcaacgcttgccccggtgctggttcctgtggtggaatgtttactgctaataccatgtcttccatttttgaagccatggggatgagtttaccctattcctcaaccatggccgccgaagatgaggaaaaagccgatagtaccgaagaatcggccaaggttttagtcgaggcggttagaaaacagattctacctagccaaattttgacccgtaaagcctttgaaaacgccatttcggtaattatggcggtgggaggttccactaacgctgtcctgcaccttttagccatttcccgcaccatcggggtagaattatcgatcgatgattttgaaaccatccgccagcgtgtaccagttatctgcgatcttaaaccctccgggcgttacgttaccgtagatctgcataaagccggcggtattccccaagtgatgaaaattctcctggttaatggtttactacacggggatgctctcaccattagcggtcagactatcgccgagattttagccgatattcccgaccaaccgccctcaggccaagatgttatccgtccttttagcaatcctgtctataaagagggtcatttagccattttaaaaggaaatctggccacggaggggtctgtggccaaaatcagcggcgtgaaaactccggtcatcactgggcccgcgcgggtgtttgagtcggaagaaacctgtttagaggcaattttagccggaaaaattcaagccggggatgtggtggttgtccgttacgagggaccagtaggcggaccgggtatgcgggaaatgttagcccccacttcggcaattatcggcgctggtttaggggattccgtgggattaattaccgatggtcgtttttccgggggaacctatggcatggtagttggtcacgtcgctccagaagcggcggtgggtggtacaattgccctagtagaggaaggggatcaaatcactattgatgctcgtcaacgtctcttgagtttaaatgtatcggaggaagaattaacccgtcgtcgtcaccattggcaaccgcgtcccccacgctataaaacgggaattctcggcaaattcgccaagttagtctcctctagcagtctcggcgctttaacggatttgaatctgttctaa

SEQ ID NO: 384 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDEEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGSVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRHHWQPRPPRYKTGILGKFAKLVSSSSLGALTDLNLF

SEQ ID NO: 385 - DNA, 1731 bp, Methylobacterium chloromethanicum
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaggcccaggccgtgaagaagggcgttgccgccgccaagggcaccccgcgcgagttctgcaccatcaccgtcaccgacggcatcgccatgggccatggcggcatgcgtgcctcgctgccgtcgcgcgaggtcatcgccgattcggtcgagctgacgatccgcggccattcctacgacgccctcgtggggctggccggctgcgacaagtccctgcccggcatgatgatggccatggtgcgcctcaacgtgccgtcaatcttcatctatggcggctcgatcctgccgggctcgttccggggccggccggtcacggtgcaggatctgttcgaggcggtcggcaaggtcgccgtcggtgacatgagcctcgacgacctcgacgagctggagcgggtcgcctgcccctcggccggcgcctgcggcgcgcagttcaccgccaacaccatggccaccgtctccgaggcgatcggcctcgcgctgccctactcggccggcgcgcctgccccttatgagatccgcgaccaattctgcgccgccgccggcgagaaggtgatggagctgatcgccaagaacatccgcccgcgcgacatcgtcacccgcaaggccctggagaacgccgctgcgacggtcgcggcctcgggcggttcgaccaacgcggccctgcacctgccggcgatcgcgcatgaatgcggcatcgagttcaccctgttcgacgtcgccgagatcttccgcaagaccccctacatcgccgacctgaagcccggtgggcgctacgtggccaaggacatgttcgaggtcggcggcatcccgctgctgatgaagacgctgctcgaccacggctacctgcacggcgactgcctcaccgtcaccggccgcaccatcgcggagaacctcgccaaggtcgcctggaacccggatcaggacgtcgtgcgcccggccgataagcccatcaccgtcaccggcggcgtggtgggccttcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttttccggcgcgacccgcggcttctgcgtcggccatgtcggccccgaggctgccatcggcgggccgatcggcctgctgcgcgacggcgacatcatcaccctcgacgcgatcaagggcacgctcgacgtggcgctctccgacgaggaactggcccagcgtcgcagcgaatgggcgccgcggggcaatgccgcgacctccggctacctctggaaatatgcgcagtccgtcggacctgcggtgaacggggccgtgacgcatccgggcggcgcgggggagacgaacgtctatgccgacatctag

SEQ ID NO: 386 - protein, 576 aa, Methylobacterium chloromethanicum
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWAPRGNAATSGYLWKYAQSVGPAVNGAVTHPGGAGETNVYADI

SEQ ID NO: 387 - DNA, 1797 bp, Schizosaccharomyces pombe
atgatgttctgcaagcttctccgttgtcaaaacggtattgctagcaaaagagctgcattaagcctaaaaggctttaaaacctcttcgatcaatttagtcgagaagaaattgaacaagtatagtgaaacaatcactggtccgaagtctcagggtgcttcccaagctatgttatatgctactggacttaatgaggaggacatgaaaaaaccccaagtcggcattgctagttgttggtatgaaggaaatccttgcaatatgcatttacttgatctcggtcgacgagtgaaagaaggtgtcaaaaaggctggattgaccggattccagtttaatactattggtgttagtgatggtatttctatgggtactactggtatgcgttatagtttgcaatctcgtgagattattgcagactccattgagaccgtcatgcaaggtcaatggtatgatgccaacgtctctattcctggctgtgacaaaaacatgcctggttgtttaatcgctatgggaagattcaaccgccctagtattatggtttacggcggtagtattcgtgctggtcactctccttgtcagaacaatgcacccatcgatattgtttctgcttttcaatcctatggtgaatttatcacaggaaaaattgatgagccaacccgtcatgacattattcgtcatgcatgtcctggaggtggtgcttgtggtggtatgtatactgcaaatacaatggctagctgtgccgaagctatgggtatgacattacccggttcttcttcttaccttgctggctcacctgagaagtttgcagaatgcgaagctgcaggtagtgctataaagcgacttttggttgacgacattaaacctcgcgacatcatgacacgttctgcttttgaaaatgctatggtcttgacgatgactcttggtggctctaccaactctgttcttcatttgatcgcaattgctaagtctgttggtatcactttaactttggatgatttccaagccgtcagtaaccgtacaccgtttattgccgatatgaagcctagcgggaagtacgttatggaagatttgttcgctatcggaggtattccttcagtacttaaatatctccatgctgaaggtctcatcgatggttctaatattaccgttactggtaaaactctcgctgagaacctacgaggattcaaggaccttgccgaaggtcaaaagatcattagacctttgagcaaccccatcaagaccgagggtcatttacgtgtcctccgtggttctttagcccctgaaggttctgtcgcaaagattactggcaaagagggcttgaacttcaccggcaaagctcgtgtttttgatgccgaaaacgattttattgctgccttagagcgtggtgagttcaagaagggcgagaagactgtcgtcattattcgttttgagggaccaaaaggtggacctggtatgccggaaatgttaaagccttcaagtgctattatgggagctggtcttggaaaggatgttgcacttttgactgacggtcgtttcagtggtggctctcacggatttttgattggacacgttgatcccgaagcacaagttggaggccctattgctcttgttcaggacggcgatgtcattgaaatcaatgctgtaaagaacactttagatttgatggttgatgagaaggagatggcgagacgccgcagtgtttggaaggcacctcctttgaagtaccaacaaggaacccttttaaaatatgctcgcaacgttagcactgcctccaagggtgctgttacagattccttagagtaa

SEQ ID NO: 388 - protein, 598 aa, Schizosaccharomyces pombe
MMFCKLLRCQNGIASKRAALSLKGFKTSSINLVEKKLNKYSETITGPKSQGASQAMLYATGLNEEDMKKPQVGIASCWYEGNPCNMHLLDLGRRVKEGVKKAGLTGFQFNTIGVSDGISMGTTGMRYSLQSREIIADSIETVMQGQWYDANVSIPGCDKNMPGCLIAMGRFNRPSIMVYGGSIRAGHSPCQNNAPIDIVSAFQSYGEFITGKIDEPTRHDIIRHACPGGGACGGMYTANTMASCAEAMGMTLPGSSSYLAGSPEKFAECEAAGSAIKRLLVDDIKPRDIMTRSAFENAMVLTMTLGGSTNSVLHLIAIAKSVGITLTLDDFQAVSNRTPFIADMKPSGKYVMEDLFAIGGIPSVLKYLHAEGLIDGSNITVTGKTLAENLRGFKDLAEGQKIIRPLSNPIKTEGHLRVLRGSLAPEGSVAKITGKEGLNFTGKARVFDAENDFIAALERGEFKKGEKTVVIIRFEGPKGGPGMPEMLKPSSAIMGAGLGKDVALLTDGRFSGGSHGFLIGHVDPEAQVGGPIALVQDGDVIEINAVKNTLDLMVDEKEMARRRSVWKAPPLKYQQGTLLKYARNVSTASKGAVTDSLE

SEQ ID NO: 389 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 390 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 391 - DNA, 1752 bp, Kluyveromyces lactis
atgttttcacagtctgctgtaagaaggttttcaaccactagaaatgtgggcaagaagttgaacaagtactcgcatatcatcaccgaaccaaaggaccagggtgcatcgcaagcgatgctttatgccacggggtttaaggaagacgatttcggcaaggctcaagttggtgttggttcatgttggtggtctggtaatccatgtaatatgcatttgatggatttcaacaacagaatcaccgaatccgttaacaaggctgggttgaaaggtatgcaattcaataccattggtgtttctgatggtatttccatgggtaccaagggtatgagatattctttgcaatctagagaagttattgctgattcgttcgaaaccattatgatggctcaacattacgatgccaatatcgccattccatcttgtgataaaaacatgcctggtgttttgatggctatgggtagacataacagaccttccattatggtttatggtggtaccattttgccaggttctccaacttgtggttctgctaagattccaaagaagattgacgttgtttctgcgttccagtcctatggtcaatacttatccaaggaatttactgaaactgaaagacaagatgttgtgcaacatgcttgtccaggtccaggttcttgtggtggtatgtacactgctaacaccatggcctctgtggccgaagtcttgggtatgactttgccaaactcttcctctttcccagcagtttcaaaggaaaaattgaacgaatgtgacactatcggtgaagctatcaagaagactatggaactaggaattactcctcgtgacgttatgaccaaagaagctttcgaaaacgctatgacatatgtcattgctaccggtggttccactaacgctgttcttcatatggttgctgtcgctcactctgccggtgtcaagattactccagatgatttccaaagaattagtgacaagactccattgttgggtgatttcaaaccttctggtaaatatgtgatggcagatttgattaccgtcggtggtacccaagctgttatcaaatacttgtacgaagaaggcttcctacatggtaacactattaccatctccggtgacactttagcagaaagagcagctaaggctgtatctttgaaggatggtcaagacatcattcgtcctctaactaacccaattaagacaagtggtcatttacaaattctatacggaagtttggccccaggtgggtcagtcggaaaaattactggtaaagaaggtacttacttcaagggtaaggctagagtattcaacgacgaaccaggctttatttctgctttagaaaacggtgaaatcaagaagggtgaaaaaaccgttgtcattatcagatacgaagggccaagaggtggtccaggtatgcctgaaatgttaaagccatcttctgcattgatgggttacggtctaggtaaggatgttgctctattgactgacggtagattctccggtggttctcacggtttcttgatcggtcacatcgtcccagaagctgccgaaggtggtcctatcggtttggttcgtgacggtgacgaaattatcattgatgctgataacaacaagattgacttgttagttccagaagaagaaatcgctgaacgtagaagtacatggactgctccacctccacgttatactagaggatgtttatccaagtacgcaaaattggtttcaaatgcttcccatggttgcgtgactgatttgaactaa

SEQ ID NO: 392 - protein, 583 aa, Kluyveromyces lactis
MFSQSAVRRFSTTRNVGKKLNKYSHIITEPKDQGASQAMLYATGFKEDDFGKAQVGVGSCWWSGNPCNMHLMDFNNRITESVNKAGLKGMQFNTIGVSDGISMGTKGMRYSLQSREVIADSFETIMMAQHYDANIAIPSCDKNMPGVLMAMGRHNRPSIMVYGGTILPGSPTCGSAKIPKKIDVVSAFQSYGQYLSKEFTETERQDVVQHACPGPGSCGGMYTANTMASVAEVLGMTLPNSSSFPAVSKEKLNECDTIGEAIKKTMELGITPRDVMTKEAFENAMTYVIATGGSTNAVLHMVAVAHSAGVKITPDDFQRISDKTPLLGDFKPSGKYVMADLITVGGTQAVIKYLYEEGFLHGNTITISGDTLAERAAKAVSLKDGQDIIRPLTNPIKTSGHLQILYGSLAPGGSVGKITGKEGTYFKGKARVFNDEPGFISALENGEIKKGEKTVVIIRYEGPRGGPGMPEMLKPSSALMGYGLGKDVALLTDGRFSGGSHGFLIGHIVPEAAEGGPIGLVRDGDEIIIDADNNKIDLLVPEEEIAERRSTWTAPPPRYTRGCLSKYAKLVSNASHGCVTDLN

SEQ ID NO: 393 - DNA, 1770 bp, Candida albicans
atgagttttgtcaaatcttgcagagggtgtcttaggacatttgctacatccacaatcaagcatgagaaaaagttaaacaagtactcgtctattgtcacaggcgacccatctcagggtgcttcccaagcaatgctttatgccactggtttcagtgatgaagatttcgatcgtgcacaaatcggtgtcggttctgtttggtggtcaggtaacccatgtaacatgcacttgatggagttgaacaacaggtgttccgaatcagtcaacaaggccggcttaaaagccatgcaattcaactccattggtgtgtcggacggtatcaccaacggaactgaaggtatgaagtactctttacagctgagagaaattatcgccgactcctttgaaaccatgaccatggcccaactatatgacggtaacattgccattccttcatgtgataaaaatatgcccggggtattgatggctatgggaagacacaacagacctgccattatggtctatggtggtactatcttgcctggatctccaacttgcggaacccaaaaccctgctgtagccgacaaaatcgatatcattagtgctttccaatcctacggacaatacttgtcaaaacaaatcaacaacgaagaaagaatagatattgtcaaacatgcctgtccagggcccggtgcatgtggtggtatgtacactgccaacactatggcctctgcctctgaagtcttggggttgaccttaccattttcgtcctcgtccccggcagtctccaaagaaaaagccgaagagtgtgccaacgtcgggttcgccttaaagaatttgttagagttggacttgaaaccaagagatattgtcaccaaaaaatcatttgaaaacgctattgcttatatcattgccactggtggttctactaatgccgttttacatcttattgccattgcctcttcatttgacattactattactgttgacgatttccaaagaatctccgacaacactcccttgttggccgatttcaaaccatcgggtaaatacgttatggccgacttgcaaaatgtcggcggtacacctgctgttatgaaatacttgatcaaagaaggcattatcgacggtacccaattgagtgtcaccggtaaaaccatcaacgaaaacttggctaaacttgctgatttgcctgagggccaagacattgttagaccagtatcaaacccattgaagccaagtggccacttacaaatcttgaaaggtactttggctccagggtctgctgtcgctaaaatcaccggtaaagaaggtacttatttcaaaggtaaagctagagtattcaacgacgaaggtgcatttattgttgccttggaaaatggcgagatcaaaaaaggcgaaaaaacagtttgtgtgatcagatacgaaggtccaaaaggtggtccaggtatgccagaaatgttgaaaccttcgtctgcattaatgggttacgggttaggtaaagacgttgctttgttgactgatggtagattttcgggtggttcccacgggttccttattggccacattgttcctgaagccgctgaaggtggtccaattgctttggttgaagatggcgatattattgtcatcgacgcagacaataacaaaatcgatttgttggttgagccagacgtcttgaccgaaagaagaaaacactggacgcctccagaaccaagatacaaaagaggtactttggccaaatacgccaagttggtcagcgatgcatctaagggatgtgttacagatttataa

SEQ ID NO: 394 - protein, 589 aa, Candida albicans
MSFVKSCRGCLRTFATSTIKHEKKLNKYSSIVTGDPSQGASQAMLYATGFSDEDFDRAQIGVGSVWWSGNPCNMHLMELNNRCSESVNKAGLKAMQFNSIGVSDGITNGTEGMKYSLQSREIIADSFETMTMAQLYDGNIAIPSCDKNMPGVLMAMGRHNRPAIMVYGGTILPGSPTCGTQNPAVADKIDIISAFQSYGQYLSKQINNEERIDIVKHACPGPGACGGMYTANTMASASEVLGLTLPFSSSSPAVSKEKAEECANVGFALKNLLELDLKPRDIVTKKSFENAIAYIIATGGSTNAVLHLIAIASSFDITITVDDFQRISDNTPLLADFKPSGKYVMADLQNVGGTPAVMKYLIKEGIIDGTQLSVTGKTINENLAKLADLPEGQDIVRPVSNPLKPSGHLQILKGTLAPGSAVAKITGKEGTYFKGKARVFNDEGAFIVALENGEIKKGEKTVCVIRYEGPKGGPGMPEMLKPSSALMGYGLGKDVALLTDGRFSGGSHGFLIGHIVPEAAEGGPIALVEDGDIIVIDADNNKIDLLVEPDVLTERRKHWTPPEPRYKRGTLAKYAKLVSDASKGCVTDL

SEQ ID NO: 395 - DNA, 1815 bp, Pichia stipitis
atgagttttttatttaaggctgctgccgcacgccgtgttgcctccaagtcgcctgctgctgtggccagatcgttttctgtctctgctactcaatgtgaaaagaaattgaacaagtactcttcgattgtcactggtgatccctcccagggtgcttcgcaagccatgctctatgccacaggtttcgacgatgccgacttcaacagagcccagatcggtgtgggctcagtttggtggtcaggtaatccttgcaacatgcacttgatggagttgaacaacaagtgtactgaatcagtcaacagagctggtttgaagggaatgcaattcaactcgattggtatttccgatgggatcactaacggaactgaaggaatgagatactctcttcaatctcgtgaaattattgctgactcgttcgaatccatgatgcttggtcaattgtacgatggtaacattgccattccatcctgtgacaagaatatgcctggtgtcttgattgctatggccagacacaacagaccttctattatggtctatggtggtacaatcttgccaggtcaaactacttgcggaaccaacaacccagctatcgccgacaaaattgatatcatctcagctttccagtcgtatggacagtacttgaccaagtccatcactaacgaagaaagaaaggatatcgttagacacgcctgtcctggtcctggtgcctgtggtggtatgtatactgctaacaccatggcatctgcagctgaatgtcttggtatgtctttgccctattcatcttcggctccagccgtctcaaaggaaaaggatgctgagtgtgccaacatcggtcaagccatcaagcacttgttggagatcgacttgaagccccgtgatattttgactaagaaatctttcgaaaacgctatcgcttatatcattgctactggtggatctacgaatgctgtattgcacttaattgccattgcttcctcagctgatattgatcttaccgtagatgatttccagagaatctccgactccactccgttgttggcagacttcaagccatcgggacaattcgtaatggcagacttacagaagtacggtggtactccagccgtgatgaaattcttgatgaacgaaggcttcattgacggagaccagtacactgtcactggtaagaccatcaaggaaaatttggcttccgtcaaggacttgcctgctgatcagcctatcatcagaccagtcagcaaccccttgaagacaagcggtcacttgcaaatcttgaagggttccttggctccaggttctgctgtcggtaagatcaccggtaaggaaggtacctacttcaagggtaaggctcgtgtctttgatgacgaaggagacttcattgtcgccttggagaagggtgagattaagaagggtgaaaagaccgtctgtgtcatcagatacgaaggtccaaaaggaggccccggtatgcctgaaatgttgaagccttcctcggccttgatgggttatggtttaggtaaagatgttgctcttttgacagacggtaggttctctggtggatcccacggcttcttgattgggcacattgttcctgaagctgctgaaggtggacctatcggtttggtgtacgatggtgacgaaatcgtcattgatgccgaaaacaacaagatcgacttgttagtagacgaagctgtgttggctgaaagaagaaagttatggactgctcctgagccaagatacaccaggggtactttggccaagtacgccagattggtcagtgacgcttctgctggatgcgttaccgacttgccaataaagaattaa

SEQ ID NO: 396 - protein, 604 aa, Pichia stipitis
MSFLFKAAAARRVASKSPAAVARSFSVSATQCEKKLNKYSSIVTGDPSQGASQAMLYATGFDDADFNRAQIGVGSVWWSGNPCNMHLMELNNKCTESVNRAGLKGMQFNSIGISDGITNGTEGMRYSLQSREIIADSFESMMLGQLYDGNIAIPSCDKNMPGVLIAMARHNRPSIMVYGGTILPGQTTCGTNNPAIADKIDIISAFQSYGQYLTKSITNEERKDIVRHACPGPGACGGMYTANTMASAAECLGMSLPYSSSAPAVSKEKDAECANIGQAIKHLLEIDLKPRDILTKKSFENAIAYIIATGGSTNAVLHLIAIASSADIDLTVDDFQRISDSTPLLADFKPSGQFVMADLQKYGGTPAVMKFLMNEGFIDGDQYTVTGKTIKENLASVKDLPADQPIIRPVSNPLKTSGHLQILKGSLAPGSAVGKITGKEGTYFKGKARVFDDEGDFIVALEKGEIKKGEKTVCVIRYEGPKGGPGMPEMLKPSSALMGYGLGKDVALLTDGRFSGGSHGFLIGHIVPEAAEGGPIGLVYDGDEIVIDAENNKIDLLVDEAVLAERRKLWTAPEPRYTRGTLAKYARLVSDASAGCVTDLPIKN

SEQ ID NO: 397 - DNA, 1705 bp, Yarrowia lipolytica
ctacgctactaaggcgcacactttgaacaagttctccaagatcatcacggagcccaagtcgcagggagcctctcaggctatgctgtacgcctgcggcttcaacgaggccgatctgggcaagccccaggttggtgtcgcctccgtctggtggtccggaaacccctgcaacatgcacctgcttgatctcaacttcaaggtcaaggagggcatcgagaagcacaacctcaaggccatgcagttcaacactattggtgtgtctgatggtatttctatgggtaccaagggtatgcgatattctctgcaatctcgagacatgattgctgactccattgagactctcatgatggcccagcactacgacgccaacatctccatcccgggctgtgacaagaacatgcccggtgttctcatggccatgggccgagtcaaccgaccctccatcatgctgtacggaggaaccatccaccccggaaaggccgagactcgaaagggcgaggacattgatattgtttccgccttccaggcctacggacagtacattgccggcggcatctctgagaccgagcgagccgatgttattcgacacgcctgccccggtcagggagcctgtggaggtatgtacactgctaacaccatggcttctgccgcagaggtgcttggtatgactctgcctggctcctcctccgctcccgccatctccaaggagaagatggccgagtgtgaggctctgggacctgccatcaacaagctgctggagatggacctcaagcctaaggatatcatgacccgacaggcctttgagaacgctattgcttacatcattgccactggaggctccaccaacgccgttctccatctgctggctatcgctcacaccgtcgacgttcctttgaccattgacgacttccagcgaatctccgataacactcctctgctcgccgacttcaagccctccggagctcacgtcatggccgatctgcagaagtggggtggaacccccgccgtcatcaagatgctcattgagcagggtttcattgatggctctcccatgacctgttccggagagtctctcaaggacaccgtcgccaagtacccctctctccccaaggagcaggatatcttcgcctctgttgacgctcccctcaagccctctggtcatctgcagattcttaagggctcccttgctcccggtggatccgtcggaaagatcaccggaaaggagggaacattcttcaagggtaccgcccgatgtttcgacgaggaggacctgttcattgaggctctggagaagggcgagatcaagaagggcgagaagacctgtgtcattattcgatacgagggccccaagggaggacccggtatgcccgagatgctcaagccctcttctgccctgatgggatacggtctgggcaaggatgttgctctgctgaccgacggacgattctccggaggatctcatggtttcctcattggtcacattgtccccgaggcttacgagggaggtcccattggtctggttgaggacggcgatgagatcatcatcgacgctgacaacaacatcatcgacctgcttgttgatgagaagaccatggctgagcgaaaggccaagtggactccccccgctcctcgatacacctctggaaccctgcacaagtactccaagcttgtgtccgacgcctccactggctgtatcactgacgcctaa

SEQ ID NO: 398 - protein, 567 aa, Yarrowia lipolytica
YATKAHTLNKFSKIITEPKSQGASQAMLYACGFNEADLGKPQVGVASVWWSGNPCNMHLLDLNFKVKEGIEKHNLKAMQFNTIGVSDGISMGTKGMRYSLQSRDMIADSIETLMMAQHYDANISIPGCDKNMPGVLMAMGRVNRPSIMLYGGTIHPGKAETRKGEDIDIVSAFQAYGQYIAGGISETERADVIRHACPGQGACGGMYTANTMASAAEVLGMTLPGSSSAPAISKEKMAECEALGPAINKLLEMDLKPKDIMTRQAFENAIAYIIATGGSTNAVLHLLAIAHTVDVPLTIDDFQRISDNTPLLADFKPSGAHVMADLQKWGGTPAVIKMLIEQGFIDGSPMTCSGESLKDTVAKYPSLPKEQDIFASVDAPLKPSGHLQILKGSLAPGGSVGKITGKEGTFFKGTARCFDEEDLFIEALEKGEIKKGEKTCVIIRYEGPKGGPGMPEMLKPSSALMGYGLGKDVALLTDGRFSGGSHGFLIGHIVPEAYEGGPIGLVEDGDEIIIDADNNIIDLLVDEKTMAERKAKWTPPAPRYTSGTLHKYSKLVSDASTGCITDA

SEQ ID NO: 399 - DNA, 1752 bp, Candida glabrata
atgtcctccagactaacttttgctaggaagttctccagcacaagaaatgttgcaaagaaactgaataaatactcatatatcatcactgagcctaaggaccaaggtgcctctcaggctatgttgtatgccactggtttcaacaaggatgatttcagcaaagcgcaagttggtgttggttcttgttggtggtctggtaacccatgtaacatgcatctattggatttgaaccacagatgttcccaatccatcgagaaagccggtatgaaaggtatgcaatttaacacaattggtgtctctgacggtatctcgatgggtactaaaggtatgagatattctttacaaagtagagaaattatcgcagactctttcgagactatcatgatggcacaacactacgatgccaatattgctattccatcctgtgacaagaatatgcctggtgttatgatggctatgggtagacacaacagaccatctattatggtttatggtggtaccattatgccaggtcacccaacttgtggctccaagaacattccagagaacattgatgttgtctctgctttccaatcctacggtcaatacatctcgaagcaattcaatgaagaagagagaagtgatgttgtacaacactcttgtccaggtcctggctcttgtggtggtatgtacaccgccaacaccatggcctctgctgccgaagttttaggtatcactatgccaaactcttctgctttcccagctgtttctgctgaaaagattgctgaatgtgacaacattggtgctgctatcaagaacactatggaacttggtattaccccacgtcaaatcttcaccaaggaatcctttgaaaacgctatcacttacgtcattgctactggtggttccactaacgcagttcttcacttggtagctattgcacactctgctggtgtcaagatcaccccagatgatttccaaaggatcagtgacaagacaccattgctaggtgacttcaagccatctggtaagtatgtcatggccgatttgattaaggtcggtggtactcaaagtgtcatcaagttcttgtatgacaacggtttcttatacggtgacgccttaactgttactggtgaaactttggctgagcgtgccaagaaagccaagggtctaagtgaaactcaagacattattagaccattgtcaaacccaattaagccaagtggccatctacaaattctatacggttctcttgctccaggtggttctgttggtaagattactggtaaggaaggtacttacttcaaaggtaaggctcgtgttttcgaagaagaagacgctttcatctctgcattggagaatggtgaaatcaagaaaggtgaaaagacagttgttattatcagatatgaaggtccaaagggtggtccaggtatgccagaaatgttgaagccatctagtgcactaatgggttatggtctaggtaaagatgttgccttgctaactgatggtagattctctggtggttctcatggtttcttgattggtcacattgttccagaagctgccgaaggtggtccaattggtttggtcagagatggtgatgaaattgtgattgatgcagacaacaacaagattgacctcctaatctctgaatctgagatgtctcaacgtaaggccgaatggaaacctccagccccacgttacaacaggggtactctatccaaatatgctaagttagtctctaatgcctcccaaggttgtgttacagacgcttaa

SEQ ID NO: 400 - protein, 583 aa, Candida glabrata
MSSRLTFARKFSSTRNVAKKLNKYSYIITEPKDQGASQAMLYATGFNKDDFSKAQVGVGSCWWSGNPCNMHLLDLNHRCSQSIEKAGMKGMQFNTIGVSDGISMGTKGMRYSLQSREIIADSFETIMMAQHYDANIAIPSCDKNMPGVMMAMGRHNRPSIMVYGGTIMPGHPTCGSKNIPENIDVVSAFQSYGQYISKQFNEEERSDVVQHSCPGPGSCGGMYTANTMASAAEVLGITMPNSSAFPAVSAEKIAECDNIGAAIKNTMELGITPRQIFTKESFENAITYVIATGGSTNAVLHLVAIAHSAGVKITPDDFQRISDKTPLLGDFKPSGKYVMADLIKVGGTQSVIKFLYDNGFLYGDALTVTGETLAERAKKAKGLSETQDIIRPLSNPIKPSGHLQILYGSLAPGGSVGKITGKEGTYFKGKARVFEEEDAFISALENGEIKKGEKTVVIIRYEGPKGGPGMPEMLKPSSALMGYGLGKDVALLTDGRFSGGSHGFLIGHIVPEAAEGGPIGLVRDGDEIVIDADNNKIDLLISESEMSQRKAEWKPPAPRYNRGTLSKYAKLVSNASQGCVTDA

SEQ ID NO: 401 - DNA, 1815 bp, Chlamydomonas reinhardtii
atgtcgtcgactgcgaccatgcccggccagcgctcggccatgaaggccgctggcgcccagagccgccgtgccgtgaaggtgatggccgtgtccgctccggagaagccgtcgtcgtccgccccggccgtcccggcaggcctgaacaagttcagcagccgcatcacgcaacccaagtaccagggcgcgtctcaggccatgctgttcgctaccggtctgcgggaggaggacatgatcaagccgcaggtgggcatctcctcggtgtggtacgagggcaacccttgcaacatgcacctgatggacctggcggcggaggtgaagaagggcgtggaggccatgggcatggtgggcttccgcttcaacaccattggtgtcagcgacggcatttccatgggcaccgacggcatgagcttcagcctgcagagccgcgacctgattgccgactccattgagacggtcatgagcgcgcagtggtacgacgccaacatctcgctgcccggctgcgacaagaacatgcccggcacgctgatggccatggcccgcctgaaccgcccctcgctcatgatctacggcggcactatcaagcccggccacagccgcatggacggctccgtgctggacatcgtgtccgccttccagagctacggcgcctactcggccggcctgatcaacgaggcccagcgtgtggacattgtgcgcaacagctgccctggcgctggcgcgtgcggcggcatgtacactgccaacaccatggcctcggccattgaggctctgggcatgaccctgccctacagctcgtccatccccgctgaggacccgctgaagaaggacgagtgccgcatggccggccgctacatgctggagctgctcaagtccgacctgaagcctctggacatcatgacctacaaggcctttgagaacgccatggtgctggtcatggccaccggcggctccaccaacgccgtgctgcacttcatcgccatggcgcgcgcctgcggcgtgcccctgaccctggacgacttccagcgcgtgtctgaccgcacgcccttcatctgcgacctcaagccctcgggccgctacgtcatggaggacatccacaaggtgggcggcacccccgccgtgctgaagtacctggactccaagggctacatcaaccgcgactgcatgaccgtcactggcaagaccatgggcggcaacctggcggaggtgccggagctgcgtgcgggccaggacgtggtgctgcccgtggagaagcccatcaagcagactggccacatccagatcctgtacggcaacctggccccggagggcagcgtggccaagatcactggcaaggagggcctgctgttcgagggcgaggcgctggtgtttgacaacgaggaggacatgatcaccatggtgggcgccgagcccaacaagttccgcggcaaggtggtggtgatccgctacgagggccccaagggcggccccggcatgcccgagatgctcacgcccacctccgccatcatgggcgccggcctgggcaaggagtgcgcgctcatcaccgacggacgcttcagcggcggcagccacggcttcgtgatcggccacgtcacgcccgaggcgcaggtcggcggccccatcgccctggtcaagaacggcgacaagattgtgattgatgtggagaagcgcgtgatggacatgaagatctccgaccaggagctggccgcgcgcaaggctgcctggaaggcgcccccgctgaaggccaccagcggcaccctgtacaagtacatcaagaacgtgtcgtcggcgtccactggctgcgtcaccgactcgtaa

SEQ ID NO: 402 - protein, 604 aa, Chlamydomonas reinhardtii
MSSTATMPGQRSAMKAAGAQSRRAVKVMAVSAPEKPSSSAPAVPAGLNKFSSRITQPKYQGASQAMLFATGLREEDMIKPQVGISSVWYEGNPCNMHLMDLAAEVKKGVEAMGMVGFRFNTIGVSDGISMGTDGMSFSLQSRDLIADSIETVMSAQWYDANISLPGCDKNMPGTLMAMARLNRPSLMIYGGTIKPGHSRMDGSVLDIVSAFQSYGAYSAGLINEAQRVDIVRNSCPGAGACGGMYTANTMASAIEALGMTLPYSSSIPAEDPLKKDECRMAGRYMLELLKSDLKPLDIMTYKAFENAMVLVMATGGSTNAVLHFIAMARACGVPLTLDDFQRVSDRTPFICDLKPSGRYVMEDIHKVGGTPAVLKYLDSKGYINRDCMTVTGKTMGGNLAEVPELRAGQDVVLPVEKPIKQTGHIQILYGNLAPEGSVAKITGKEGLLFEGEALVFDNEEDMITMVGAEPNKFRGKVVVIRYEGPKGGPGMPEMLTPTSAIMGAGLGKECALITDGRFSGGSHGFVIGHVTPEAQVGGPIALVKNGDKIVIDVEKRVMDMKISDQELAARKAAWKAPPLKATSGTLYKYIKNVSSASTGCVTDS

SEQ ID NO: 403 - DNA, 1704 bp, Ostreococcus lucimarinus
atgcccgacggcgacgcgagcgatttgaacaagtggtcgagaaagatcacgcaaccgaagagccaaggagcgtcgcaggcgatgctgtacgccacgggcctgacggaggccgatatgaacaaaccgcagatcggcgtgtcctcggtgtggtggcagggaaacccttgtaacaaacacttgctggacctggcgggtaaagtggcggaaggcgtcaaggcggcggatatggtgagctttcagtttaacaccgtgggggtgtcggacgggatttccatgggtacgccgggcatgtccttctcgttgcaatcgcgggatttgatcgcggatagcatcgagaccgtgatgggtggacagtggtacgacggaaatatttctctcccggggtgcgataagaacatgccgggtacgatcatggccatgggtcgattgaaccgcccgtcgctgatgatttacggcggtaccattcgccctggccactccgccgtggatggtggcacactcgatatcgtatccgcgttccaatcgtacggacagttcgttaccggcgctatcacggaggaacagcgcaaagacatcgtgcgtaactcttgcccgggctctggcgcgtgcggcggcatgtacaccgccaacaccatggccagctgcatcgaggctctcggcatgactcttccgtattcttcctccattcccgcggaagatcctctcaagatggatgaatgtttcatggctggcgctgcgatgaagcatttgctcgaaatcgacctgaagccgcgtgacatcatgactcgcgcggcgttcgaaaacgccatggtcaccgtcatcgctctcggcggttccaccaacgcggttcttcacttgatcgcgatggcgcactctgtcggcatcaaattgactctggacgacttccaagccgtctccaacaagacgccgttcatcgctgacttaaagccgtccggtaagtacgtcatggaggacgtccacaaggttggcggcactccggcggtgttgaagtatttgatgtctgaaggcatgattgacggttcttgcatgactgtcaccggtaagaccctcgccgagaacctcgccatctgcccggatttgacgccggggcaagatgttattctcccggtgagcacgcccatcaagaagactggtcacttgcaatgcttgtacggcaacatcgcccagggaggctccgtggcgaagatcaccggtaaggaaggcttgtactttaaaggcttcgcgaagtgctacgatagcgaagaggaaatgctcgaggccttggcggcagactccgagtctttcaagggtagcgtcatcgtcattcgctacgaaggtccgaagggtggtccgggcatgccggagatgctcacgccgacgtcggccatcatgggtgccggtctcgggaacgactgcgcgctcatcacggatggtcgattctccggtggctcgcacggtttcgtcatcggtcacgttacgccggaagcgcaagttggtggtaacatcggtttgatcaaggacggtgatatcatcgaaattgatgccgaagttcgcaccatcaacgcgccggatgtcaccgacgccgagtgggaaaagcgtcgagcggcgtggaaggcgccgcctttggaagcgacgtcgggtacgctctacaagtactgcaagctcgtcgccagcgcttcggaaggctgcatcacggacttgtga

SEQ ID NO: 404 - protein, 567 aa, Ostreococcus lucimarinus
MPDGDASDLNKWSRKITQPKSQGASQAMLYATGLTEADMNKPQIGVSSVWWQGNPCNKHLLDLAGKVAEGVKAADMVSFQFNTVGVSDGISMGTPGMSFSLQSRDLIADSIETVMGGQWYDGNISLPGCDKNMPGTIMAMGRLNRPSLMIYGGTIRPGHSAVDGGTLDIVSAFQSYGQFVTGAITEEQRKDIVRNSCPGSGACGGMYTANTMASCIEALGMTLPYSSSIPAEDPLKMDECFMAGAAMKHLLEIDLKPRDIMTRAAFENAMVTVIALGGSTNAVLHLIAMAHSVGIKLTLDDFQAVSNKTPFIADLKPSGKYVMEDVHKVGGTPAVLKYLMSEGMIDGSCMTVTGKTLAENLAICPDLTPGQDVILPVSTPIKKTGHLQCLYGNIAQGGSVAKITGKEGLYFKGFAKCYDSEEEMLEALAADSESFKGSVIVIRYEGPKGGPGMPEMLTPTSAIMGAGLGNDCALITDGRFSGGSHGFVIGHVTPEAQVGGNIGLIKDGDIIEIDAEVRTINAPDVTDAEWEKRRAAWKAPPLEATSGTLYKYCKLVASASEGCITDL

SEQ ID NO: 405 - DNA, 1695 bp, Vitis vinifera
atgcaagcagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcgacctagtattatggtttatggtggagctatcaagcctggtcattttcaaggccatacttacgacataatatctgcctttcaggtttatggagagttcgtcagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaaggtctgttggtctgcagttaactcttgatgattttcagaaagtaagtgatgaggttccattccttgctgatcttaagcccagtggcaaatacgtcatggaggacatacacaagattggaggaacaccggcaatcattcgcttccttttggaaaatgggtttttagatggggattgtataacagttactgggaagacattggctgaaaatgcagaactttttccttctttgcccagagatcagcaaataataagaccgttggcaaaccccataaagaagactggacacctccaaactttatatggaaatcttgcaccagagggttctgttgcaaaaattactggaaaagaagggctatatttctctggtcctgcacttgtctttgaaggtgaggaagctatgattgcagctatagcagagaatcctatgagctttaaggggaaagtagttattattagaggagagggacccaagggggggccaggaatgcctgaaatgttgactccaacaagcgcaataatgggagcaggtcttgggaaggatgttgctttgttgactgatggtaggttttcaggaggttcacatggatatgttgttggccacatatgtcctgaagcacatgtacattttcttttccttcatccagttttatttttttatttttttgatcagaaacgaagaagattatattaa

SEQ ID NO: 406 - protein, 564 aa, Vitis vinifera
MQAALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKPGHFQGHTYDIISAFQVYGEFVSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARSVGLQLTLDDFQKVSDEVPFLADLKPSGKYVMEDIHKIGGTPAIIRFLLENGFLDGDCITVTGKTLAENAELFPSLPRDQQIIRPLANPIKKTGHLQTLYGNLAPEGSVAKITGKEGLYFSGPALVFEGEEAMIAAIAENPMSFKGKVVIIRGEGPKGGPGMPEMLTPTSAIMGAGLGKDVALLTDGRFSGGSHGYVVGHICPEAHVHFLFLHPVLFFYFFDQKRRRLY

SEQ ID NO: 407 - DNA, 1839 bp, Vitis vinifera
atgcaagtagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcggcctagtattatggtttatggtggagctatcaagaggcagattgacaattataattgggatcccaatcataccatcctgtgtagtgtggcacaccactttatactgagatatgaaatgttgtatgaagtcatctttgagaaatggcatgatcctggtcattttcaaggccatacttacgacataatatctgcctttcagctatggtctgaaggaggtgtatgtgtagtatcacttgtcccatggtttatggagagttcgtccagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaagaattgctcatgataagattcttggcaggtctgttggtctgcagttaactcttgatgattttcagaaagtaagtgatgaggttccattccttgctgatcttaagcccagtggcaaatatgtcatggaggacatacacaagattggaggaacaccggcaatcattcgcttccttttggaaaatgggtttttagatggggattgtataacaggtcctgcacttgtctttgaaggtgaggaagctatgattgcagctatagcagagaatcctatgagctttaaggggaaagtagttattattagaggagagggacccaaggggggcccaggaatgcccgaaatgttgactccaacaagcgcaataatgggagcaggtcttgggaaggatgttgctttgttgactgatggtaggttttcaggaggttcacatggatatgttgttggccacatatgtcctgaagcacatgaaggtggtcccattggtctcattgaaaatggagatatcatcacaattgatgtccaaaaaaggagaatggatgtccagctgacagatgaagagatgaatgagcgaagaaagaaatggagtcccccaccatataaggctaaccaaggagttctatacaagtacatcaagaacgtaaaatcggcttcagatgggtgtgtgacggatgaataa

SEQ ID NO: 408 - protein, 612 aa, Vitis vinifera
MQVALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKRQIDNYNWDPNHTILCSVAHHFILRYEMLYEVIFEKWHDPGHFQGHTYDIISAFQLWSEGGVCVVSLVPWFMESSSSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARIAHDKILGRSVGLQLTLDDFQKVSDEVPFLADLKPSGKYVMEDIHKIGGTPAIIRFLLENGFLDGDCITGPALVFEGEEAMIAAIAENPMSFKGKVVIIRGEGPKGGPGMPEMLTPTSAIMGAGLGKDVALLTDGRFSGGSHGYVVGHICPEAHEGGPIGLIENGDIITIDVQKRRMDVQLTDEEMNERRKKWSPPPYKANQGVLYKYIKNVKSASDGCVTDE

SEQ ID NO: 409 - DNA, 1827 bp, Arabidopsis thaliana
atgcaagccaccatcttctctccacgcgccactctcttcccctgtaaacctctcctcccttcccacaatgtcaactctcgccgtccctcaatcatctcctgctccgcccaatccgtaaccgctgatccttcaccacctatcactgacaccaataagctcaacaaatacagctcaagaatcactgaacccaaatcccaaggtgggtctcaagcaattcttcacggtgttggtttatcagacgacgatttgctaaaaccccagattggtatctcgtcggtttggtatgaagggaacacttgtaacatgcatttgctgaaattgtctgaggctgtgaaagaaggagttgaaaatgcaggaatggttgggtttaggtttaatactattggtgtgagtgatgctatttcgatgggaacgagagggatgtgttttagtttgcaatctagggatttgattgctgatagtattgagactgttatgagtgctcagtggtatgatggtaacatatctattcccggttgtgataaaaatatgcctggaactattatggctatgggaaggcttaacagaccagggattatggtttatggtggaaccattaagcctggccattttcaagacaagacatatgacattgtatctgctttccagagttatggagaatttgttagtggctccataagtgatgaacagagaaagactgtcctccatcattcatgtcctggagctggagcctgtggtggcatgtacacagcgaatacaatggcttctgctatcgaagcaatgggaatgtcccttccttacagttcttcaatacctgctgaagacccattgaagttggacgagtgtcgcttagcaggaaaatatcttctagaattgctaaagatggacttaaaaccccgtgacattatcactccaaaatcacttcgtaatgcaatggtttccgtcatggcccttgggggatcgacaaatgcagtattgcatctaattgctattgcaaggtctgttggtttggagttgactcttgacgattttcagaaagttagcgatgcggttccatttctagcagatcttaaacccagtgggaagtatgttatggaggatatacataagataggtggtacgccagctgttctccgctatttattagagctaggattgatggatggtgattgtatgacagtgacagggcagactttggctcaaaatttagaaaacgtcccaagcttaacagaagggcaggagataattagacctctgtcaaatccaatcaaggagactggacacatacaaattttgagaggagaccttgcaccagatggttctgtagcaaaaattaccggcaaagagggcttatatttctctggtcctgcacttgtatttgaaggagaggaatctatgttggctgctatatcagcagacccaatgagttttaagggaactgtggttgttatcagaggagaggggcctaaaggaggtccaggtatgcctgagatgttgacaccgacaagtgcaataatgggtgccggtcttggaaaggaatgtgcattactgactgatggtaggttctctggtgggtcacacggttttgttgttggccacatttgccctgaagctcaggagggtggtccgatcggtctgatcaagaacggagacataatcaccattgacataggaaagaagagaatagacacacaagtctcacccgaagaaatgaatgaccgtagaaagaaatggactgctcctgcatacaaggttaaccgcggagtcctatataagtacatcaagaacgtgcaatcggcttcagatggatgtgtgactgacgagtaa

SEQ ID NO: 410 - protein, 608 aa, Arabidopsis thaliana
MQATIFSPRATLFPCKPLLPSHNVNSRRPSIISCSAQSVTADPSPPITDTNKLNKYSSRITEPKSQGGSQAILHGVGLSDDDLLKPQIGISSVWYEGNTCNMHLLKLSEAVKEGVENAGMVGFRFNTIGVSDAISMGTRGMCFSLQSRDLIADSIETVMSAQWYDGNISIPGCDKNMPGTIMAMGRLNRPGIMVYGGTIKPGHFQDKTYDIVSAFQSYGEFVSGSISDEQRKTVLHHSCPGAGACGGMYTANTMASAIEAMGMSLPYSSSIPAEDPLKLDECRLAGKYLLELLKMDLKPRDIITPKSLRNAMVSVMALGGSTNAVLHLIAIARSVGLELTLDDFQKVSDAVPFLADLKPSGKYVMEDIHKIGGTPAVLRYLLELGLMDGDCMTVTGQTLAQNLENVPSLTEGQEIIRPLSNPIKETGHIQILRGDLAPDGSVAKITGKEGLYFSGPALVFEGEESMLAAISADPMSFKGTVVVIRGEGPKGGPGMPEMLTPTSAIMGAGLGKECALLTDGRFSGGSHGFVVGHICPEAQEGGPIGLIKNGDIITIDIGKKRIDTQVSPEEMNDRRKKWTAPAYKVNRGVLYKYIKNVQSASDGCVTDE

SEQ ID NO: 411 - DNA, 1785 bp, Oryza sativa
atgcagtcgcttgccctcacctccccctcccttccggcgccggcgaccgcatccggccgccgccgccgccgcctggagcgcatccgcgccaccgcggtgtccgacgagccgaagctgaacaagtacagcgcgcgcatcacggagcccaagtcgcagggggcgtcgcaggcggtgctctacggcgtggggctcaccgacgccgacctccgcaagccgcaggtgggcgtctcctctgtctggtacgagggcaacacctgcaacatgcaccttctccgcctcgccgaggccgtcagggacggcgtccgcgaggccggcatggtggccttccgcttcaacaccgtcggggtcagcgacgccatctccatgggcacccggggcatgtgctacagcctccagtcgcgcgacctcatcgccgacagcatcgagaccgtcatgggcgcgcagcactacgacgccaacatctccattcctggatgcgacaagaacatgccaggaacaataatggcaatggggcggctgaaccgaccaagtatcatgatatatggtggaactattaagcctggtcattttcagggtaattcttatgacatagtatctgctttccagtgctatggagaatttgttaccggatcaatcagtgatgagcaaagaaagaatgtgctccgcaactcatgcccaggagcaggtgcgtgtggtggtatgtacaccgcgaacacaatggcatccgccatcgagaccatgggtatgagccttccgtacagttcttcaacccctgctgaagacccactaaagctagaggaatgccgtcttgctgggaagtatcttttagaattgttaaagatggatttgaagcctgaagacattatcactgagaaatctttgcggaacgcaatggtcattgtcatggcacttggtgggtctactaatgctgttttgcatttaattgctatcgctaggtctgtaggtctgcaattaactcttgatgattttcagaaggtcagtgaccaagttcctttccttgcggaccttaagcctagtggcaaatatgtcatggaggatctgcataagattggtggaacacctgcagtaattcattatcttctggagcaaggtcttcttgatggtgattgtatgaccgtcactgggaaaactctagcggaaaatgctaaaatcttccctcctctgtccgaaggacagcaaataataaggcccctggacaacccaatcaaatcaactggtcatatacaaatactttatggcaatcttgcaccagaaggttctgtagcaaaaattactggcaaagaggggatgtttttctcaggccctgcactagtgtttgagggtgaagaatctatgattacagctatatcagaaaacccagcgaatttcaaggggaaggtagtagtgatacgaggagaaggaccgaaaggtggaccagggatgcctgaaatgctgactccaactagtgcaataatgggtgctggtcttgggaaggagtgtgccctgctgaccgatggcagattttctggaggatcacatggatttgttgtaggccacatttgtcctgaagcacaggagggaggtccaattggtcttgttcaaaacggtgacaaaattaccattgatgttgtgaagagagtaattgatgttgaactgactgaagctgagctggaagaaagacggaggaaatggacgccgccgccacacaaggctgcccgtggagcgctttggaagtacacgaagctcgtgtcccctgcatcaagaggatgcgtcaccgatgagtag

SEQ ID NO: 412 - protein, 594 aa, Oryza sativa
MQSLALTSPSLPAPATASGRRRRRLERIRATAVSDEPKLNKYSARITEPKSQGASQAVLYGVGLTDADLRKPQVGVSSVWYEGNTCNMHLLRLAEAVRDGVREAGMVAFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEFVTGSISDEQRKNVLRNSCPGAGACGGMYTANTMASAIETMGMSLPYSSSTPAEDPLKLEECRLAGKYLLELLKMDLKPEDIITEKSLRNAMVIVMALGGSTNAVLHLIAIARSVGLQLTLDDFQKVSDQVPFLADLKPSGKYVMEDLHKIGGTPAVIHYLLEQGLLDGDCMTVTGKTLAENAKIFPPLSEGQQIIRPLDNPIKSTGHIQILYGNLAPEGSVAKITGKEGMFFSGPALVFEGEESMITAISENPANFKGKVVVIRGEGPKGGPGMPEMLTPTSAIMGAGLGKECALLTDGRFSGGSHGFVVGHICPEAQEGGPIGLVQNGDKITIDVVKRVIDVELTEAELEERRRKWTPPPHKAARGALWKYTKLVSPASRGCVTDE

SEQ ID NO: 413 - DNA, 1767 bp, Physcomitrella patens
atggtggtggcgtcgtcgagcgcggaaggggctgtggccgcgccgcccccgcagtccgtggaggcgccggctgggagcgccacggacagcgcgaagctgaacaagtactcaagccgcgtgacccagcctaaggcgcagggcgcctcgcaggcgattctgtacggggtggggttgtccgaggaggatatgaacaagccgcaggtgggaatctcgtcggtttggtacgagggcaacacgtgcaatatgcatttgctgcatttgtctgaggctgtgaaggagggggtgaaggaggccgggatggtggggttccgattcaacactgtgggagttagtgacgccgtgtccatgggaaccgaggggatgtgctacagcctgcagtcgcgcgatttgattgcggacagtgtggagactgttatgggcgggcagtggtacgacgccaacatttccattccggggtgtgataagaacatgcccggggtggtcatggccatggggcggctgaacaggcccagcattatgatttatgggggcaccatcaagccaggtcattttaacggacagacgctcgacatcgtttcagccttccagagctacggagagtatgtgagcgggtccatctccgaggatgagaggatggacgttgtaaggaattcttgccccggattcggagcttgtggaggaatgtacaccgccaacaccatggcgtccgccattgaagcgctaggcatgtcgctgccgtacagctcttccatccccgccgaggacccgttgaagatcgaggaatgcaaattggccgggaaatacattctggagcttctaaagcgtgacttgaagccgcgtgacattatcacccgaaagtcgctcaacaacgctatggtggttgtcatggcgctcggaggttccacgaatgcggtgcttcatctcatcgccatcgctcgttctgtgggcgttgagctcacattggacgatttccaggacgtgagcgacaagaccccgttcattgctgatcttaaacctagcgggaagtacgtgatggaggatttgcacaaaattggaggcgtgcctgccgtactgaagtacttgttagaaaaagggctaatcgacgggagctgcatgacagtcacggggaagaccatcgctgagaacctcgctgagtgcccgcccctctccgaaggtcagaagatcatcatgcctctcgaaaaccccatcaaaaaaactggtcacttgcaaattctgtggggcaaccttgctccagagggttccgttgctaaaattacaggcaaagaaggcttgtacttttctggccccgcccgtgtatttgagggagaggaagccatgctggacgctatcactgaggaccctcagagcttgaagggtactgtgatcgttatccgaggggagggtcctaagggtggcccgggcatgcctgagatgctcacccccacgagtgctgtaattggagctggacttggcaaggaagtagcgcttctgaccgacggtcgattctctggtggctctcacggcttcgttgttgggcacatctgcccagaagctcaagtaggtggcccgattgggcttgtacgtgatggagacgtgatcaccatcgacgtggagaagaggaaaatcaacgtcgatttgacggcacaagagcttgcggatcgaaaactcctgtggagagctcccccttacaaggcctctcgtggaaccctttacaagtacatcaagaatgtcaaatcagcgtccgaaggttgcgtgactgatgagtga

SEQ ID NO: 414 - protein, 588 aa, Physcomitrella patens
MVVASSSAEGAVAAPPPQSVEAPAGSATDSAKLNKYSSRVTQPKAQGASQAILYGVGLSEEDMNKPQVGISSVWYEGNTCNMHLLHLSEAVKEGVKEAGMVGFRFNTVGVSDAVSMGTEGMCYSLQSRDLIADSVETVMGGQWYDANISIPGCDKNMPGVVMAMGRLNRPSIMIYGGTIKPGHFNGQTLDIVSAFQSYGEYVSGSISEDERMDVVRNSCPGFGACGGMYTANTMASAIEALGMSLPYSSSIPAEDPLKIEECKLAGKYILELLKRDLKPRDIITRKSLNNAMVVVMALGGSTNAVLHLIAIARSVGVELTLDDFQDVSDKTPFIADLKPSGKYVMEDLHKIGGVPAVLKYLLEKGLIDGSCMTVTGKTIAENLAECPPLSEGQKIIMPLENPIKKTGHLQILWGNLAPEGSVAKITGKEGLYFSGPARVFEGEEAMLDAITEDPQSLKGTVIVIRGEGPKGGPGMPEMLTPTSAVIGAGLGKEVALLTDGRFSGGSHGFVVGHICPEAQVGGPIGLVRDGDVITIDVEKRKINVDLTAQELADRKLLWRAPPYKASRGTLYKYIKNVKSASEGCVTDE

SEQ ID NO: 415 - DNA, 1800 bp, Chaetomium globosum
atgctctctccgtctctgctgcgcactggcgctcccagggccctggccatgagccgggtcttgccttttaggaaccagtaccgtctcctatccacaacaccccgccggtatgccgacgagaagctcaaccggatttcctccaagatcacacaaccgaagtcgcagggtgcctcccaggctatgctctacggtaccggcttgaccgaggcagacatgtccaaggcccaggtcggcatctcgtccgtctggtacgagggcaacccctgcaacatgcacctgatggagctctctggccatgtccgcaacagcatcgaaaaggccgggctcgtccctatgcgcttcaacaccatcggtgtttctgacggcatcagcatgggcaccacgggcatgcgctacagcttgcagagcagagagatcatcgccgacagcatcgagacggtcatgcagggccagtggtacgacgccaacgtgtcgctgcccggctgcgacaagaacatgcctggtgtcctgatcgccatgggccgcgtcaacaggcctagcattatggtctacggtggcaccatcaagccgggctgcaccatgaagggcgagcccatcgacatcgtcagcgccttccaggcgtacggccagtacatctcgggcgagatcgacgagaagcagcgcttcgacatcatccgcaacgcctgccctggcggcggcgcctgcggtggcatgtacacggccaacaccatggcctcggcgatcgagaccctcggcatgaccctccctggcagcagcagcttcccggccgaggacgcgcgcaagaaggccgagtgcgagagcgtgggcgaggccatcaagaacctcctccgcgagaacatccggcctagcgacatcctgacccgacaggcgtttgagaacgccatggtcgtcgtcggcgtgctgggcggcagcaccaacgctgtgctgcacctcatcgccatcgccgactcggtcggcatcaagctcactatcgacgacttccaagccgtctcggaccgtatccctttactcgccgatctgaagccctcaggcaagtacgttatggaggacctgttcaagatcggcggcaccccggcgctgctcaagttcctcctcaaggagggcctcctcgacggctcgggcattaccgtgactggtaagaccatgaaggagaacgtcgccgacctgcccggcttccccgcggaccagcccatcatccgccccctaaacaacccgctcaagccgacgggccacatccagatcctgcgcggctcgctcgcccccggcgggtcggtgggcaagatcacgggcaaggagggcctccggttcgagggcacggccaaggtgtacgactacgaggatgccttcatcgaggcgctggagcggggcgagatcaagaagggcgagaagacggtggtggtgatccggtacgagggccccaagggcgggcccggcatgcccgagatgctcaagcccagctcggccatcatgggcgccgggctcggccaggacgtcgccctcatcaccgacggccgcttctccggcggcagccacggcttcctcatcggccacatcgtgcccgaggccatggaaggcgggcccatcggcctagtccgcgacggcgacaagattgtcatcgacgccgacaagcgcgtcctcgacctcgaggtgcccgccgacgaaatggcgcgccgcaaggccgagtggaaggcccccgagcccagggccaagcgcggtaccctgaagaaatacgcctcgctggtcagcgatgccagccaggggtgtgtcaccgacaaatag

SEQ ID NO: 416 - protein, 599 aa, Chaetomium globosum
MLSPSLLRTGAPRALAMSRVLPFRNQYRLLSTTPRRYADEKLNRISSKITQPKSQGASQAMLYGTGLTEADMSKAQVGISSVWYEGNPCNMHLMELSGHVRNSIEKAGLVPMRFNTIGVSDGISMGTTGMRYSLQSREIIADSIETVMQGQWYDANVSLPGCDKNMPGVLIAMGRVNRPSIMVYGGTIKPGCTMKGEPIDIVSAFQAYGQYISGEIDEKQRFDIIRNACPGGGACGGMYTANTMASAIETLGMTLPGSSSFPAEDARKKAECESVGEAIKNLLRENIRPSDILTRQAFENAMVVVGVLGGSTNAVLHLIAIADSVGIKLTIDDFQAVSDRIPLLADLKPSGKYVMEDLFKIGGTPALLKFLLKEGLLDGSGITVTGKTMKENVADLPGFPADQPIIRPLNNPLKPTGHIQILRGSLAPGGSVGKITGKEGLRFEGTAKVYDYEDAFIEALERGEIKKGEKTVVVIRYEGPKGGPGMPEMLKPSSAIMGAGLGQDVALITDGRFSGGSHGFLIGHIVPEAMEGGPIGLVRDGDKIVIDADKRVLDLEVPADEMARRKAEWKAPEPRAKRGTLKKYASLVSDASQGCVTDK

SEQ ID NO: 417 - DNA, 1791 bp, Neurospora crassa
atgctcgctccctcccttctgcgggctcaggcccccagagctctggcttctgcccgtctctccctccgctccctctccaccactccccgccgctacaatgcccaggagaagcagctcaacaaggtgtcggccaacatcacccagcccaagtctcagggtgcttcccaggccatgctctacgccaccggcctcaacgaggacgacatgaacaaggcccaggtcggtatctcgtctgtctggtatgagggcaacccttgcaacatgcaccttctcgacctctccggcctcgtcaaggagtccgttgccaaggctggcctcgtccccatgcgcttcaacaccatcggtgtctcggacggtatctccatgggtaccaccggtatgcgctacagcttgcagtcccgtgagattattgccgactccatcgagaccgtcatgaacggccagtggtacgacgccaacatctccctccccggttgcgacaagaacatgcccggtgtcctcatcgccatgggccgtgtcaaccgcccctccatcatggtctacggtggtaccatcaagcccggctgcaacatgaagggcgagaacatcgatatcgtttccgccttccaggcatacggccagtacatctccggtgagatcgacgagaagcagcgcttcgatatcatccgcaacgcctgccctggtggtggcgcctgcggtggcatgtacactgccaacaccatggccaccgccatcgagaccctcggcatgacccttcccggttcctcctcctaccccgccgagtctcccgagaagaagaacgagtgcttgagcgtcggtgaggccatcaagaacctcctccgcgaggacatccgccccaccgatatccttactcgccaggccttcgagaacgccatgatcgtcgtcaacattcttggcggttccaccaacgccgtcctccacttgattgccatcgccgactccgttggcatcaagctcaccatcgatgacttccaggccgtctccgaccgcactcctttccttgccgacctcaagccttccggcaagtgggtcatggaggaccttagcaagattggcggcacccccgcccttctcaaattcctcctcaaggagggaatcctcgacggctccggcatcacctcgaccggtaagaccatgaaggagaacgtcgagaagttccccgacttccccaccgaccaggccatcatccgccctctgtcgaaccccatcaaggaaaccggacacattcagatcctccgcggctctctcgctcccggcggttccgtcggcaagatcaccggcaaggagggtctccgtttcgagggtaaggctcgctgcttcgactacgaggacggctttattgaggctctcgagcgtggcgagatcaagaagggcgagaagaccgtcgtcgtcatccgctacgagggtcccaagggcggccctggcatgcccgaaatgctcaagccttcgtccgccattatgggctacggtctcggcaaggacgttgccctcatcactgacggccgcttctccggtggttctcacggcttcctcatcggccacattgtgcctgaggctatggagggtggccccattggtctcgtccgcgatggcgacaccatcgtcatcgacgccgagaagaaggttcttgaccttgaggttcctgaggaggagctcgccaagcgccgcaaggagtggaaggctcctgagcccaaggctaagcgtggtactctcaggaagtacgcccagctcgtcaaggatgctagctctggctgcgtcactgacgcttaa

SEQ ID NO: 418 - protein, 596 aa, Neurospora crassa
MLAPSLLRAQAPRALASARLSLRSLSTTPRRYNAQEKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 419 - DNA, 1788 bp, Magnaporthe grisea
atgatgtcctcaaacctgctgcgcgccagggtgcccaaggccctggctgccaccaggagccatgcggccctcttctccacaacctcgcgccgcgctgagcaactgaacaagacttcggccaagatcacacagcccaagtcccagggtgcgtcacaggccatgctgtacgccaccggcttgaccgaggaggacatgaacaagccgcaggtcggcatctcgtcggtctggtacgagggcaacccctgcaacatgcacatcctcaagctgtcggagcggatccgcgactccgtcaaggccgccaacctggtccccatgcgcttcaacaccattggagtctcggacggtatcagcatgggcacgaccggcatgcgctattcgctgcagagccgtgagatcatcgccgacagtatcgagaccgtcatgcagggccagtggtacgatgccaacatctccatcccgggctgcgacaagaacatgcccggtgttctcatcgccctcggccgtgtcaaccgccccagtttgatcgtttacggcggtaccatcaagcccggctgcagccaaaagggcgagcccatcgacatcgtcagcgccttccaggcctacggccagtacctgactggtgagatcaccgaggagcagcggttcgacatcatccggaacgcgtgccccggcggtggtgcatgcggtggcatgtacactgccaacactttggcgtcggctatcgagactctgggcatgagcttgccgggaagcagcagcaaccccgcagagcaccccagcaagctggccgaatgtgaccaggttggcgaggccatcaagaacatcctccgtgaggacgtgcgcccccgcgacatcatgacgaggcaggcctttgagaacgccatggttgtagtcagcatccttggtggaagcaccaacgccgtcctgcacctgcttgccgttgccgatgcggtcggtgtcaagcttaccattgacgacttccaagccgtttccgaccggacaccgctcctggcagacctcaagccttcgggcaaatacgtcatggaggatgtacacaagattggtggcacgccatctctcctgcgcttcctggccaaggagggcttgatcgatgcttctggcatcaccgtcactggcaagaccatgaaggagaacttggacaagtaccccgacttcccggccgaccagcccatcatccggcctctcagcaaccccctcaagtccacgggccacatccagatcctccgcggtagtctcgcacccggtggctctgtcggcaagattaccggcaaggagggtcttcagttcactggcaaggcccgctgctacgactgcgaggacgactttatcgagtcgctcgagcgtggcgagatcaagaagggtgagaagacggttgtcatcatccgttacgagggccccaagggtggtcccggcatgcccgagatgctgaagcccagctcggccatcatgggtgccggtctcggcaaggacgttgccctcatcactgacggtcgcttctctggcggttcgcacggattcctcatcggacacgttgtgcccgaggccatggagggcggacctatcgcacttgttcgcgatggcgacaccattactattgatgcggagaagcgggtgatcgacacggacgtgtcggacaagaccatggcggagcgccgcgccgagtggaaggctcccccgatcagggagaccaggggaacgctggccaagtacgcagcgctggttagcgacgcgagcagtggttgcgtgacggacaaggtcgcgcgataa

SEQ ID NO: 420 - protein, 595 aa, Magnaporthe grisea
MMSSNLLRARVPKALAATRSHAALFSTTSRRAEQLNKTSAKITQPKSQGASQAMLYATGLTEEDMNKPQVGISSVWYEGNPCNMHILKLSERIRDSVKAANLVPMRFNTIGVSDGISMGTTGMRYSLQSREIIADSIETVMQGQWYDANISIPGCDKNMPGVLIALGRVNRPSLIVYGGTIKPGCSQKGEPIDIVSAFQAYGQYLTGEITEEQRFDIIRNACPGGGACGGMYTANTLASAIETLGMSLPGSSSNPAEHPSKLAECDQVGEAIKNILREDVRPRDIMTRQAFENAMVVVSILGGSTNAVLHLLAVADAVGVKLTIDDFQAVSDRTPLLADLKPSGKYVMEDVHKIGGTPSLLRFLAKEGLIDASGITVTGKTMKENLDKYPDFPADQPIIRPLSNPLKSTGHIQILRGSLAPGGSVGKITGKEGLQFTGKARCYDCEDDFIESLERGEIKKGEKTVVIIRYEGPKGGPGMPEMLKPSSAIMGAGLGKDVALITDGRFSGGSHGFLIGHVVPEAMEGGPIALVRDGDTITIDAEKRVIDTDVSDKTMAERRAEWKAPPIRETRGTLAKYAALVSDASSGCVTDKVAR

SEQ ID NO: 421 - DNA, 1797 bp, Gibberella zeae
atgctttcccggtcactgctgcgctctagagctgtgggagctttccccctctctgccaggaatcatggccgcttcctgtctaccacctccatccgctccgatgacaagctcaacaagatctcctccaacatcactcagcccaaggcccagggtgcttcccaggctatgctctacgccaccggcctctctgaagctgacatgaacaaggctcaagttggcatctcgtccgtctggtacgagggaaacccttgcaacatgcaccttatggacctctctgcccacgtcaaggagtctgtcgccaaggccggtcttattccctaccgattcaacaccatcggtgtctctgatggtatctccatgggtaccactggtatgcgatattccctccagagccgagagattattgccgatagtgttgagactgtcatgaacggtcaatggtatgacgccaacgtcagcttgcccggttgcgacaagaacatgcccggtgttgccattgccatgggtcgtgtcaaccgtcccagcatcatggtttacggtggtaccattaagcccggttgcaccaagcagggcgagtctatcgatatcgtctctgctttccaggcctacggtcaatacatcaccggcgagatcaccgaggagcagcgattcgacattatccgaaatgcctgccctggtggtggtgcttgtggtggcatgtacactgccaacaccatggctactgccattgagactctgggacttaccctccctggtagcagcagcagccctgctgaggaccccagcaagatcgccgagtgtgaggctgttggacctgctatccgcaacattctcaaggaagatatccgacctcgtgacatcatgactcgccaagcctttgagaatgccatgatcgtcactaccatccttggtggcagcaccaacgctgttctgcatcttatcgcaattgccgactctgtcggtatcaagctcgacatcgaggacttccaaaaggtttccgaccgcactcccttccttgccgacctgaagccctctggaaagtgggtcatggccgatatgcacaagattggtggtactcctgctcttctcaagttcctcttgaaggagggtatcattgacggctctggtatcactgtcactggcaagaccatgaagcagaacgtcgaggagttgcctggattccccgaggatcaaaccatcattcgcccccttagcaaccccattaagcctaccggtcacatccagattctccgtggatccctggctcctggtggctgtgttggtaagatcactggcaaggagggtctccgattcgagggtaaggcccgtgtctacgactccgagcccgccttcatctctagccttgaggctggtgagatcaagaagggtgagaagactgtcgttatcatccgatatgatggacccaagggtggccccggtatgcctgagatgctgaagccttcttctgccattatgggtgctggccttggacaggatgtcgcccttctcactgacggtcgcttctctggtggttctcacggtttcattattggtcacattgtccccgaggcaatggagggtggccctatcgcccttgtcgaggacggtgacaccatcgttatcgacgccgagtctcgtgctatcgacctcgttgttcccgaggcagaggttgatcgccgtcgcaaggcctggaaggctcccgctccccgatacaccaagggcacactcagcaagtacgctcgactggtgaccaacgccagtgagggctgtgtcaccgatagcggtctcaagaactaa

SEQ ID NO: 422 - protein, 598 aa, Gibberella zeae
MLSRSLLRSRAVGAFPLSARNHGRFLSTTSIRSDDKLNKISSNITQPKAQGASQAMLYATGLSEADMNKAQVGISSVWYEGNPCNMHLMDLSAHVKESVAKAGLIPYRFNTIGVSDGISMGTTGMRYSLQSREIIADSVETVMNGQWYDANVSLPGCDKNMPGVAIAMGRVNRPSIMVYGGTIKPGCTKQGESIDIVSAFQAYGQYITGEITEEQRFDIIRNACPGGGACGGMYTANTMATAIETLGLTLPGSSSSPAEDPSKIAECEAVGPAIRNILKEDIRPRDIMTRQAFENAMIVTTILGGSTNAVLHLIAIADSVGIKLDIEDFQKVSDRTPFLADLKPSGKWVMADMHKIGGTPALLKFLLKEGIIDGSGITVTGKTMKQNVEELPGFPEDQTIIRPLSNPIKPTGHIQILRGSLAPGGCVGKITGKEGLRFEGKARVYDSEPAFISSLEAGEIKKGEKTVVIIRYDGPKGGPGMPEMLKPSSAIMGAGLGQDVALLTDGRFSGGSHGFIIGHIVPEAMEGGPIALVEDGDTIVIDAESRAIDLVVPEAEVDRRRKAWKAPAPRYTKGTLSKYARLVTNASEGCVTDSGLKN

SEQ ID NO: 423 - DNA, 1797 bp, Aspergillus niger
atgttcgcgtcgagtatccgatcgagagctctgggattgagcccacgagcccggtttgagaatactcgtcttccatcttccactagcgggcgccgttatagatccgatgagcccctcaaccgaatttcctcgaaaatcacacaacccaaatcccagggtgcttcgcaagcaatgctctacgccaccggcctaacagaggaagacatgtccaagccacaggtcggtatctcctcggtgtggttcgagggtaacccatgcaacatgcacttgcatgacctgtctgccattgtgcgcgattccgtgctccgtgcgggtctggtccctatgcgattcaactcagttggagtgtcggatgggatcagtatgggtacaaagggaatgagatacagcctgcagagccgggagctgatcgctgatggtattgagacggtgatgaatgcccagtggtacgatgcgaatgtgtcgctcccgggttgtgataagaatatgccaggtgtattaatagcgatgggacgcacgaaccgacctagcatcatggtctacggtggcagtatcaagcctggatgcagtgcaaagggccagaaattggacctggtcagtgcattccagtcatatggccagttcatcaccggccagatcgacgagaaggagcggttcgatatcattcgcaatgcatgccccggcagaggtgcatgcggtggcatgtacacggctaatacgctggccacggctattgagactatgggaatgactattcctggtagtagtagttgcccggcagatgatcgcaagaagctagttgagtgcgaaaatattggcgaggtggttaaaaatatgctcagggaagatatcaaacccagggatatcttaacacgtcaagccttcgagaatgcaatgattgtagtgaacgtgctgggtggcagtactaatgctgttttacatctgattgccattgctgactctgtcggtatcaagttgactattgatgacttccaggcagtatctgataagacaccgttcctggctgatttgaagccatctggaaagtatcttatgaatgatctttataatatcggtggcacaccagccctcctgaaatatctcctgaaggagggcttgatcgatggctcaggagttactgttaccggtaaaacaatgaaggaaaatgtagcctcatggcctgattttcctgctgaccaggatatcatccgccccctcaacaaccctatcaaaccatctggccatctccagattcttcgcggatcgctggccccgggcggttccgtgggtaagattactggaaaggagggtctgcggtttgagggtatagctaaatgctatgattacgaagatgcattcattgagtcccttgagcggggtgagatcaagaagggcgagaaaacagtcgtgattatccggtatgaaggccccaagggtggcccaggaatgcctgagatgctcaagcccagcgcggccattatgggcgctggacttggccaggacgttgctcttcttacagatggaagattctcgggtggcagtcacggatttttgatcggacatatcgtgccggaagccatggaaggcggcccgatcgcgttggctcgagacggtgatcggatcgtgattgatgctgaggaaagagtggtcgatctggatatctctactgaggagctcgagaagaggaggaaggagtggaacgcacccccgctccggtaccagaagggaactctgaagaaatattgcacgctggtcagcgacgccagccatggttgtgtcacggacggaccgatatag

SEQ ID NO: 424 - protein, 598 aa, Aspergillus niger
MFASSIRSRALGLSPRARFENTRLPSSTSGRRYRSDEPLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLIAMGRTNRPSIMVYGGSIKPGCSAKGQKLDLVSAFQSYGQFITGQIDEKERFDIIRNACPGRGACGGMYTANTLATAIETMGMTIPGSSSCPADDRKKLVECENIGEVVKNMLREDIKPRDILTRQAFENAMIVVNVLGGSTNAVLHLIAIADSVGIKLTIDDFQAVSDKTPFLADLKPSGKYLMNDLYNIGGTPALLKYLLKEGLIDGSGVTVTGKTMKENVASWPDFPADQDIIRPLNNPIKPSGHLQILRGSLAPGGSVGKITGKEGLRFEGIAKCYDYEDAFIESLERGEIKKGEKTVVIIRYEGPKGGPGMPEMLKPSAAIMGAGLGQDVALLTDGRFSGGSHGFLIGHIVPEAMEGGPIALARDGDRIVIDAEERVVDLDISTEELEKRRKEWNAPPLRYQKGTLKKYCTLVSDASHGCVTDGPI

SEQ ID NO: 425 - DNA, 1875 bp, Neosartorya fischeri
atgttcgcgtcgagtatccgatcgagagctctgggattgagcccacgagcccggtttgagaatacgtacgagaggaccttccctcgcattgcttctctctccctcctcaaaaatcggcaaatactaataactatcgttactagtcgtcttccatcttccactaccgagcgccgttataaatccgacgagaccctcaaccgaatctcctcgaaaatcacacaacccaaatcccagggtgcctcacaagcaatgctctacgccaccggcctgacagaggaagacatgtccaagccgcaggtcggtatctcctcggtgtggttcgagggtaacccatgtaacatgcacttgcatgacctgtctgcgattgtgcgtgattccgtgcttcgggcgggtctggttcctatgcgattcaactcggttggagtgtcggatgggatcagtatgggcacaaagggaatgagatacagcctacagagtcgggagctgatcgctgatggcattgagacagtgatgaatgcccagtggtatgatgcgaatgtgtcgctcccaggttgcgataagaatatgccaggtgtgttaatggcaatgggacgcacgaatcggcctagtatcatggtctatggcggcagtatcaaacccggatgcagtgcaaagggccaaaagttagacctggtcagtgcattccagtcatatggacagttcatcaccggccagatcgatgagaaggaacggtttgatataattcgcaatgcatgccccggcagaggtgcctgcggtggcatgtacacagctaatacgctggccacagccattgagactatgggtatgaccgttcccggtagcagtagttgcccggcagacgatcctaagaagcttgttgagtgcgaaaacatcggggaggtggttaagactatgctcagggaagatatcaagcccagggatgtcttgacacgtcaagcttttgagaatgcaatgattgtggtgaacgtgctgggtggcagcactaatgctgttctacatctgattgctattgctgactctgttggtatcaagttgactattgatgacttccagacagtgtctgacaagacaccattcctagctgatttgaagccatctggaaaataccttatgaatgacctatacaacatcggtggcacaccagccctccttaaatatctcctaaaggagggcttgatcgatggctcaggaattactgtcactggcaaaacaatgaaggagaatgtagcctcatggcctgacttccctgctaaccaggatatcattcgccccctcagcaaccctattaaaccatctggtcatctccagattcttcgcggatcgctggccccgggcggttctgttgggaagattactggaaaggagggtctgcggtttgagggcacagctaagtgctatgactacgaagatgcattcattgagtcccttgagcggggcgagatcaagaagggcgacaaaacagtcgtgattattcggtatgaaggtcccaagggtggcccaggaatgcctgagatgctcaagcccagcgcggccattatgggtgctggtcttggccaggacgttgcacttctcacggacgggagattctcaggtggcagtcacggattcttgatcggacatattgtgccggaagccatggagggtggcccgatcgcgttagcacgagacggtgatcggatcgtgattgatgctgaggaaagagtggttgatctggatatcccgattgaagagctcgagaagaggaggaaggagtggaaagcacccccgctccgataccagaagggaactttgaagaagtattgcacgctggtcagcgatgccagccatggttgtgtcacagacggcccgatctag

SEQ ID NO: 426 - protein, 624 aa, Neosartorya fischeri
MFASSIRSRALGLSPRARFENTYERTFPRIASLSLLKNRQILITIVTSRLPSSTTERRYKSDETLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLMAMGRTNRPSIMVYGGSIKPGCSAKGQKLDLVSAFQSYGQFITGQIDEKERFDIIRNACPGRGACGGMYTANTLATAIETMGMTVPGSSSCPADDPKKLVECENIGEVVKTMLREDIKPRDVLTRQAFENAMIVVNVLGGSTNAVLHLIAIADSVGIKLTIDDFQTVSDKTPFLADLKPSGKYLMNDLYNIGGTPALLKYLLKEGLIDGSGITVTGKTMKENVASWPDFPANQDIIRPLSNPIKPSGHLQILRGSLAPGGSVGKITGKEGLRFEGTAKCYDYEDAFIESLERGEIKKGDKTVVIIRYEGPKGGPGMPEMLKPSAAIMGAGLGQDVALLTDGRFSGGSHGFLIGHIVPEAMEGGPIALARDGDRIVIDAEERVVDLDIPIEELEKRRKEWKAPPLRYQKGTLKKYCTLVSDASHGCVTDGPI

SEQ ID NO: 427 - DNA, 1626 bp, Neosartorya fischeri
atgctgtatgcgactggtttggaggaagcggatatgaacaaggcccaggtgggaatctcctcggtgtggtttgagggaaacccttgcaacatgcacctgatggacttgtccttggtggtacgcgactcggtcgccagggccggcctggttccaatgcgttttaactcgattggcgtttccgacggaatcagcatgggcacgagcggtatgcgatacagtctgcagagtcgtgagatcatcgcggacggcattgagacggtcatgaacgggcagtggtatgacgcgaatatctcacttccaggatgcgataagaacatgcccggtgttgttatggccatgggccgggtcaaccgtccgagcattgtgatctatggtggtagtattaagcctggttgcagcgctggtggccagactttggatctggtgagcgcctttcagtcatatggccaatacattactggtcagatagatgaagcacagcgctttgacatcattcgccatgcgtgcccgggaagtggtgcgtgtggtggcatgtatacagcgaataccatggccacagctattgaagttctcgggctcacggttccaggcagtagtagctgccccgcagaagatccgcgcaagaaagctgaatgtgaagagattggagaaacagtcaagaacctcttgaaggaagatatccggccttcggatattttgacccgccaagcatttgagaacgcaatgatcgtggtcaatattttgggaggtagcaccaatgcagtcatgcatttgattgccattgcccaatctgtgggaattaagctcaccattgatgatttccaagctgtgtctgacaagacgccatttctggccgacctaaaaccatcaggaaagtatgtcatgcatgacctgtacaagatcggcggcacaccggccctactccggttcctgctcaaggagggcttgattgacgggtctggtattactgtgaccggcaaaacaatgaaggagaatgttgcatcttggcctgatttccctgaagatcagcccattatccggccactgagcgatcccatcaagcccacgggtcaccttcaaattctgcgaggatccttggcacctggaggctccgttggtaagatcaccggtaaagagggtctccgatttgaaggcagtgccaagtgctacgactatgaagatgcctttgtggatgctcttgaaaagggagaaattaagaagggtgaaaagacagttgttattatccgatacgaggggccaaagggtggtccaggtatgccggaaatgctcaagcctagtgccgccatcatgggtgccggactgggtcaggatgtcgccctccttaccgacggtcgattttctggtggcagtcatggattcctaatcggtcatattgttcctgaggcaatggatggtggtccaatcgccctggtcaaagatggggacagggtgattatcgacgcagagaagagggtggttgatctggatatatccggagaagagatgcagaggaggaagaaggcatggaaagcgcctgaacctcgggcaaagaaaggcactctaaagaagtatgcagctcttgtcagtgacgctagccatggctgtgtcactgatgggccactttga

SEQ ID NO: 428 - protein, 541 aa, Neosartorya fischeri
MLYATGLEEADMNKAQVGISSVWFEGNPCNMHLMDLSLVVRDSVARAGLVPMRFNSIGVSDGISMGTSGMRYSLQSREIIADGIETVMNGQWYDANISLPGCDKNMPGVVMAMGRVNRPSIVIYGGSIKPGCSAGGQTLDLVSAFQSYGQYITGQIDEAQRFDIIRHACPGSGACGGMYTANTMATAIEVLGLTVPGSSSCPAEDPRKKAECEEIGETVKNLLKEDIRPSDILTRQAFENAMIVVNILGGSTNAVMHLIAIAQSVGIKLTIDDFQAVSDKTPFLADLKPSGKYVMHDLYKIGGTPALLRFLLKEGLIDGSGITVTGKTMKENVASWPDFPEDQPIIRPLSDPIKPTGHLQILRGSLAPGGSVGKITGKEGLRFEGSAKCYDYEDAFVDALEKGEIKKGEKTVVIIRYEGPKGGPGMPEMLKPSAAIMGAGLGQDVALLTDGRFSGGSHGFLIGHIVPEAMDGGPIALVKDGDRVIIDAEKRVVDLDISGEEMQRRKKAWKAPEPRAKKGTLKKYAALVSDASHGCVTDGPL

SEQ ID NO: 429 - DNA, 1845 bp, Aspergillus niger
atgccttttctgcggtggcctccaggccagaaaatcatgatcacacctaccactcctttccgagctgccagaactctggcattcggtggacggatactatcgcccaaaaagtcatcctctcgtcttctctcctcaactgcacatagttatgccgacgaaacactgaacaaagtctcctctaagatcacacaacccaagtcccagggtgcatctcaagcgatgctttacgcgaccggcttgacggagaaagacatgtccaaggcacaggttggaatttcatcagtgtggttcgaagggaatccttgtaacatgcacttgatggatttgtcgtcgctggttcgcgagtcggtagccaaagctggcctggttcccatgcgtttcaactccatcggcgcctctgatggcattagtatgggcacatctggcatgcgattcagtttacagagccgagagatcattgctgatggaattgaaacggtcatgaatgcccagtggtatgatgctaatatctcgttgcctggctgtgataagaacatgccaggtgtgctgatggctatgggtcgggtcaaccgtccgagtatcatggtgtatggtggtagtatcaagcccggctgcagtgcggggggtaagccacttgacttggtcagcgcctttcaatcgtatggccaatatctcactggtgagatcgacgagaaggaacgatttgatattatccgacacgcttgcccaggtgctggtgcctgtgggggtatgtatacggctaatacactggcaacggccatcgagaccctcggaatgacggtccctggaagcagcagtacaccggcagaggatccgaggaagctggcagagtgtgaggacatcggtcagacggtgaagaatctgctgaaggaggacatccgtcccaaggatatcatgacacggcaggcatttgaaaatgctatgattgttgtgaatattcttggaggcagcaccaatgcagtgctgcacttgattgctatcgctaattccgttgggatcaaattgactatcgatgacttccaggctgtgtcagacaagacacctttcttagctgatctaaagccttccggcaagtatgtcatgcatgacctgtacaaagtcgggggcacgcctgcactgctgaagttcctgctcagggaaggccttattgacggctccggcgtcactgttactggcaaaaccatgaaagagaatgtagcctcatggcccgaattttcacctgagcagcccatcatccgccctctaagcaatcccatcaagccaaccggccacttgcagatccttcgtgggtcattggcccccggcggctcggttggaaaaatcaccggcaaagaaggtctacggttcgaaggtcttgctaaatgttacgactttgaggacgctttcattgaggctctcgaacgaggcgagatcaagaagggcgagaaaacggtcgttattattcgatatgaagggcccaaaggcggccccgggatgcctgagatgctcaagcccagctcagctatcatgggcgcgggattgggtcaggatgttgcgctactcactgatggaagattctctggaggtagtcatggctttttaattgggcatgttgtgcctgaggctatggagggtgggcccattgccctggtgaaggatggcgatcggatcgtaattgatgcggagcaaagagtggttgacctgctgatcaccccagaagaaatggcaaagagaagagtgtcttggacagcaccggcacctcgggcgaagaaggggacattaagcaagtatgcgaagctggtgagcgatgcgagccatgggtgcgtgacggatggtccaatatag

SEQ ID NO: 430 - protein, 613 aa, Aspergillus niger
MPFLRWPPGQKIMITPTTPFRAARTLAFGGRILSPKKSSSRLLSSTAHSYADETLNKVSSKITQPKSQGASQAMLYATGLTEKDMSKAQVGISSVWFEGNPCNMHLMDLSSLVRESVAKAGLVPMRFNSIGASDGISMGTSGMRFSLQSREIIADGIETVMNAQWYDANISLPGCDKNMPGVLMAMGRVNRPSIMVYGGSIKPGCSAGGKPLDLVSAFQSYGQYLTGEIDEKERFDIIRHACPGAGACGGMYTANTLATAIETLGMTVPGSSSTPAEDPRKLAECEDIGQTVKNLLKEDIRPKDIMTRQAFENAMIVVNILGGSTNAVLHLIAIANSVGIKLTIDDFQAVSDKTPFLADLKPSGKYVMHDLYKVGGTPALLKFLLREGLIDGSGVTVTGKTMKENVASWPEFSPEQPIIRPLSNPIKPTGHLQILRGSLAPGGSVGKITGKEGLRFEGLAKCYDFEDAFIEALERGEIKKGEKTVVIIRYEGPKGGPGMPEMLKPSSAIMGAGLGQDVALLTDGRFSGGSHGFLIGHVVPEAMEGGPIALVKDGDRIVIDAEQRVVDLLITPEEMAKRRVSWTAPAPRAKKGTLSKYAKLVSDASHGCVTDGP

SEQ ID NO: 431 - DNA, 1848 bp, Aspergillus niger
atgcttctttcccaaacccgggggcgtatgccctccgctctccggagcatcgccaagcgctctttgctgaacagtcgccctctgtctaccactctgcccaagcaacagaacggcaacgatgacgagtatactggtctcaacaaggtctcccgccacattacccagcccatctcccagggtgcttcccaggccatgctgtatgccgcaggcctcactgaggcggacatgaacaaggctcaggtcggcatttcttctgtctggtacaatggcaacccctgcaacatgcatctgctcgatcttaacaaccgtgtccgcgagggtgtccagaaggccggtttggtcggtttccagttcaacaccgtcggtgttagcgatgctatcagtatgggtaccaagggaatgcgattctctctccagagtcgtgatctgattgccgactctatcgagaccgttatgggtggtcaatggtatgacgctaacatcagcattcccggctgtgacaagaacatgcctggtgtgttgatggcaatgggacgagtgaaccgccccagtttgatggtctacggtggaaccatcaagcctggttgcgcctccatgcagggcaacgccgacattgatatcgtctccgccttccaggcctatggtcagttcatcagtaaggaaatcaccgagccccagagatttgacattatccgcaacgcctgccctggaggtggtgcttgcggtggtatgtacactgccaataccatggccactgctatcgaagtcatgggcatgacccttcctggatcctcttccaaccccgccgagtctgacgctaagtaccttgaatgtcttgcggctggtgaggccatcaagaccctgctcaaggaggacattcgtccttcggacatcctgactcgccaagctttcgagaacgccatggtcttggtcaacatcactggtggctccaccaacgccgttcttcacttgattgccattgcggactctgttggtatcaagctcgacattgaagacttccagtccgtctcggatcgcattcctttcctggcggaccttaagccttccggcaagtacgtcatggctgaccttcacaagatcggtggtaccccctccctgctcaagttcttgctgaaggaaggtctcatcgatggctctggcatgactgtcactggtcagaccctggccaagaacttggagaatgtgccggacttccctgaggatcagaagatcatccgtcccctgtccaaccccatcaaggagactggccacatccagatcttgaggggttctctggccccgggtggcagtgtcggcaagatcactggtaaggaaggaaccgtcttcactggaaaggctcgcgtctttgacgacgaggatgatttcattgctgctctcgagcgcaacgagatcaagaaggaggagaagactgttgttgtcatccgctacactggtcctaagggaggacctggcatgcccgaaatgctgaagccctcttccgccctgatgggtgccggtctcggacagtcctgcgctctgatcaccgatggccgtttctctggtggttctcacggtttcttgatcggacacattgttcccgaagccgccgtcggtggccccattggcttggttaaggatggtgatgtcatcaccattgacgccgagaagcgtgttctggaccttgatgttgaggagaccgagctcgcgcaaagaagaaagcagtgggaagccgacagggctgctggcaagctccctcccaccggcctgaccctgagaggtactctcggcaagtacgctagaaccgtcaaggatgccagccacggctgtatcaccgactctctcgaataa

SEQ ID NO: 432 - protein, 615 aa, Aspergillus niger
MLLSQTRGRMPSALRSIAKRSLLNSRPLSTTLPKQQNGNDDEYTGLNKVSRHITQPISQGASQAMLYAAGLTEADMNKAQVGISSVWYNGNPCNMHLLDLNNRVREGVQKAGLVGFQFNTVGVSDAISMGTKGMRFSLQSRDLIADSIETVMGGQWYDANISIPGCDKNMPGVLMAMGRVNRPSLMVYGGTIKPGCASMQGNADIDIVSAFQAYGQFISKEITEPQRFDIIRNACPGGGACGGMYTANTMATAIEVMGMTLPGSSSNPAESDAKYLECLAAGEAIKTLLKEDIRPSDILTRQAFENAMVLVNITGGSTNAVLHLIAIADSVGIKLDIEDFQSVSDRIPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDDEDDFIAALERNEIKKEEKTVVVIRYTGPKGGPGMPEMLKPSSALMGAGLGQSCALITDGRFSGGSHGFLIGHIVPEAAVGGPIGLVKDGDVITIDAEKRVLDLDVEETELAQRRKQWEADRAAGKLPPTGLTLRGTLGKYARTVKDASHGCITDSLE

SEQ ID NO: 433 - DNA, 1833 bp, Aspergillus terreus
atgcttctctctcagacccggggccgtctgccctccctgcggaccctcaagcggtccatggcggtccgtccgctctctaccaccctccccaagcacaaggccgatgagaaagagcctgtcctcaacaaagtctcccgccatgtcacccaacccatctcccagggtgcgtcccaggccatgctctacgccaccggtctcaccgaggccgacatgaacaaggcccaggtcggtatctcctccgtctggtacaatggcaacccctgcaacatgcacctcctcgacctcaacaaccgtgtgcgggagggtgtccagaaggctggcctggtcgggttccagttcaacaccgtcggagtcagcgacgcgatcagcatgggtacctccggtatgcgcttctcgctgcagagccgtgatctcattgccgactccattgagactgtcatgggtggtcagtggtacgacgccaacatcagtatccctggttgcgacaagaacatgcccggtgtcctgatggccatgggcagagtcaaccgtcccagtctgatggtttacggtggttccattaagcccggctgcgcttcgatgcagaacaacgccgatatcgatatcgtctccgccttccaggcgtacggtcagttcatcagcggagagatcaccgagccccagcgtttcgacatcatccgcaacgcctgccccggaggtggcgcgtgcggtggtatgtacaccgccaacaccatggccaccgccatcgaggtcatgggtatgacccttcctggttcctcctccaaccccgccgagtcggcggccaagaacatcgagtgtctggcggccggtgaggccatcaagaagcttctggtggaagacatccgtccctccgatatcctgactcgccaggccttcgagaatgccatgattgttgtgaacattaccggtggttcgaccaatgcggtgctgcaccttatcgccattgccgattcggtcggcatcaagctagatattgaggacttccagaaggtctcggaccgtgtgccgttcctggctgacctcaagccttccggcaagtacgtcatggcggacctgcacaagatcggtggtactccttctctgctcaagttcctgcttaaggagggcctgatcgatggctctggtatgaccgtcaccggtcagaccctggccaagaacctggagaacgtgccggacttccccgaggaccagaagatcatccgtcctctgtctaaccccatcaaggagaccggtcacatccagattctccgtggctctctggcccctggcggtagtgtcggtaagatcactggtaaggagggtaccgttttcaccggtaaggctcgcgtcttcgaccacgaggacgacttcatcgctgcgctcgagcgcaaggagatcaagaaggaggagaagacggtcgttgtcatccgttatactggacccaagggtggtccgggtatgcctgaaatgctgaagccttcttctgccctcatgggcgccggtctgggcggctcctgcgctctgatcaccgacggacgtttctccggcggctctcacggattcctgatcggacatatcgtccccgaggctgctgtcggtggaccgattggtctggttaaggacggcgatgtgatcaccatcgacgccgtcaagcgtgtgctggatctggacgttgacgagaccactctggccgagagaagaaagcagtgggaggccgacaaggaggctggccgtctccctcctaccggtctgactctgcgtggtaccctgggcaagtatgctagaaatgtcaaggatgccagccacggctgcatcaccgatgctcttgactaa

SEQ ID NO: 434 - protein, 610 aa, Aspergillus terreus
MLLSQTRGRLPSLRTLKRSMAVRPLSTTLPKHKADEKEPVLNKVSRHVTQPISQGASQAMLYATGLTEADMNKAQVGISSVWYNGNPCNMHLLDLNNRVREGVQKAGLVGFQFNTVGVSDAISMGTSGMRFSLQSRDLIADSIETVMGGQWYDANISIPGCDKNMPGVLMAMGRVNRPSLMVYGGSIKPGCASMQNNADIDIVSAFQAYGQFISGEITEPQRFDIIRNACPGGGACGGMYTANTMATAIEVMGMTLPGSSSNPAESAAKNIECLAAGEAIKKLLVEDIRPSDILTRQAFENAMIVVNITGGSTNAVLHLIAIADSVGIKLDIEDFQKVSDRVPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDHEDDFIAALERKEIKKEEKTVVVIRYTGPKGGPGMPEMLKPSSALMGAGLGGSCALITDGRFSGGSHGFLIGHIVPEAAVGGPIGLVKDGDVITIDAVKRVLDLDVDETTLAERRKQWEADKEAGRLPPTGLTLRGTLGKYARNVKDASHGCITDALD

SEQ ID NO: 435 - DNA, 1824 bp, Aspergillus clavatus
atgcttctctctcagacccggggccgtgtgccctctgttctccggagcttctcccgccgctccctctctaccaccatccccagatacaccgccgataaggatgactctgctctcaacaaggtgtcccgcaatgtcacacagcccatctcgcagggtgcctcccaggccatgctgtacgccacgggtcttaccgaggcggacatgaacaaggctcaggtcggtatctcgtcggtctggtacaatggcaacccctgcaacatgcatctgctcgatctcagcaaccgcgttcgcgaaggagtccagaaggctggtctggttggcttccagttcaacacggtcggtgtcagtgatgccatcagcatgggcaccaagggcatgcgcttctccctgcagagccgtgacctgattgccgactccatcgagaccgtcatgggtggtcagtggtacgacgccaacatcagtatccccggttgcgacaagaacatgcccggtgtgctcatggccatgggccgtgtcaaccgccccagtttgatggtgtatggtggtaccatcaagcccggctgcgccaaaacccagaacaacgccgacatcgacattgtctcggccttccaggcgtacggacagttcctgactggcgagatcaccgagccccagcgcttcgacatcatccgtaacgcctgccccggcggtggtgcttgcggtggtatgtacactgccaacaccatggccaccgccatcgaggtcatgggtatgaccctgcctggctcgtcgtccaaccccgctgagtctaaggccaaggaccttgagtgcttggctgctggtgaggccatcaagcgcctgctgaaggaggatatccgtccctcagacatcctgacccgccaggccttcgagaacgccatgattgtggtcaacatcaccggtggctccaccaacgccgtacttcacttgatcgccattgccgactccgtcggcatcaagctggacatcgaggagttccagaaggtctcggaccgcacccccttcctggcggacctcaagccctccggcaagtacgtcatggccgatctgtacgacatcggcggaactcctgctctgctcaagttcctgctcaaggagggcgtcatcgacggctccggcatgaccgtcaccggtgagaccctggccaagaacttggagaaggtgcccggcttccccgaggaccagaagatcatccgtcctttttcgaaccccatcaagaagactggccacattcagatcctgcgcggctccctggcccccggcggcagtgttggcaagatcaccggtaaggagggtacccgcttcgttggcaaggcccgcgtcttcgaccacgaggacgacttcattgccgctctcgagcgcaacgaaatcaagaaggaggacaagaccgttgtcgtcatccgctacaccggccctaagggtgggcccggcatgcctgaaatgctcaagccctcctccgccctgatgggcgccggcctcggctcctcctgcgcactcatcaccgacggtcgtttctccggcggctcccacggcttcctgattggccacatcgtccccgaggccgccgtcggcggccccatcggcctcgtccaggacggcgacatcatcaccatcgacgccgagaagcgcatcctcgacctcgacgtccccgagcccgagctcgcccagcgcagaaaggattgggaggccgccaaggccgccggcaagttgccccagaccggtctcaccatgagaggtaccctgggcaaatatgccagaaccgtcaaggatgccagccacggctgcattactgattatatagaataa

SEQ ID NO: 436 - protein, 607 aa, Aspergillus clavatus
MLLSQTRGRVPSVLRSFSRRSLSTTIPRYTADKDDSALNKVSRNVTQPISQGASQAMLYATGLTEADMNKAQVGISSVWYNGNPCNMHLLDLSNRVREGVQKAGLVGFQFNTVGVSDAISMGTKGMRFSLQSRDLIADSIETVMGGQWYDANISIPGCDKNMPGVLMAMGRVNRPSLMVYGGTIKPGCAKTQNNADIDIVSAFQAYGQFLTGEITEPQRFDIIRNACPGGGACGGMYTANTMATAIEVMGMTLPGSSSNPAESKAKDLECLAAGEAIKRLLKEDIRPSDILTRQAFENAMIVVNITGGSTNAVLHLIAIADSVGIKLDIEEFQKVSDRTPFLADLKPSGKYVMADLYDIGGTPALLKFLLKEGVIDGSGMTVTGETLAKNLEKVPGFPEDQKIIRPFSNPIKKTGHIQILRGSLAPGGSVGKITGKEGTRFVGKARVFDHEDDFIAALERNEIKKEDKTVVVIRYTGPKGGPGMPEMLKPSSALMGAGLGSSCALITDGRFSGGSHGFLIGHIVPEAAVGGPIGLVQDGDIITIDAEKRILDLDVPEPELAQRRKDWEAAKAAGKLPQTGLTMRGTLGKYARTVKDASHGCITDYIE

SEQ ID NO: 437 - DNA, 1842 bp, Aspergillus nidulans
atgcttctttcacagactcggggccgcctgccctctgctctccgcagcttggccaacagagctgctattcgtccaatctctactacactcccccgccaaaaagcgtcgccaaaagatgatgagcccgtcctcaacaaggtctcccgccatatcacacagccggtgtcccagggtgcttcccaggcgatgctgtacgctacgggtcttactgaggccgacatgaacaaggcccaggttggtatttcctcggtctggtacaacggcaacccttgcaacatgcacctcctcgacctgaacaaccgtgtccgcgagggtgtgcaaaaggctggccttatcgggtaccagttcaacaccattggtgtcagtgatggaatcagtatgggtaccagtggtatgcgttactcgcttcagagccgtgacctcatcgccgactctatcgagaccgtcatgggtggtcagtggtacgacgccaacatcagcatccccggttgcgacaagaacatgcccggtgttttgatggctatgggacgagtcaaccgccccagtttgatggtttacggtggaaccatcaagcccggctgcgcatccatgcagggcaacgctgacatcgatatcgtctctgccttccaagcctacggccagttcatcagcggtgagatcaacgagccccagcgcttcgatatcatccgccacgcctgccccggtggcggcgcttgcggtggaatgtacactgccaacaccatggccacggccatcgaagtcatgggtatgaccctcacgggctcctcgtccaacccggccgaatcgcaagccaaatacgacgaatgtcttcgcgctggtgaagccatcaagcgcctcctcgtcgaagacatccgcccctccgacatcatgactcggcaagccttcgagaacgccatggtcgttgtcaacatcaccggcggctccaccaatgctgtccttcacctcatcgccattgccgactccgtcggcatcaagctcacaattgacgacttccaagccgtctctgaccgcacccccttcctcgcagacctcaagccatccggcaaatacgttatggccgacctccacaacatcggcggcaccccctccctcctcaaattcctcctcaaggaaggcgtcattgatggctccggcatcacagttaccggtgaaactctcgccaagaacctcgagaaagtccccgatttccccgaggaccagaaaatcattcgccccttctccaaccccatcaaggaaacaggccacatccagatcctgcgcggttcgctcgcgccgggcggttgcgttggtaagattaccggtaaggagggaaccgttttcacgggcaaggcccgcgtctttaaccacgaagacgacttcattgccgccctggagcgcaaggaaatcaccaaggatgagcaaactgtcgttgtgattcgctacaccggtcccaagggtggtcccggtatgcctgaaatgctcaagccttcaagcgccctcatgggtgctggcctcggccaaacctgcgccctgatcacagacggacgcttctccggtggttcgcacggcttccttattggacacatcgtcccagaggctgccgtcggtgggccgattggtctcgtacacgacggcgacgtgatcaccattgatgccgagaagcgcgttttggaccttgacgttgacgaggcggaactcgctaagcgacggaagcagtgggaggctgataaggcggcgggcaagttgccccagaccgggttgaacttgcgcgggacgcttggaaagtatgcccggaatgtcaaggatgctagttccgggtgtattacggacgctttcgattaa

SEQ ID NO: 438 - protein, 613 aa, Aspergillus nidulans
MLLSQTRGRLPSALRSLANRAAIRPISTTLPRQKASPKDDEPVLNKVSRHITQPVSQGASQAMLYATGLTEADMNKAQVGISSVWYNGNPCNMHLLDLNNRVREGVQKAGLIGYQFNTIGVSDGISMGTSGMRYSLQSRDLIADSIETVMGGQWYDANISIPGCDKNMPGVLMAMGRVNRPSLMVYGGTIKPGCASMQGNADIDIVSAFQAYGQFISGEINEPQRFDIIRHACPGGGACGGMYTANTMATAIEVMGMTLTGSSSNPAESQAKYDECLRAGEAIKRLLVEDIRPSDIMTRQAFENAMVVVNITGGSTNAVLHLIAIADSVGIKLTIDDFQAVSDRTPFLADLKPSGKYVMADLHNIGGTPSLLKFLLKEGVIDGSGITVTGETLAKNLEKVPDFPEDQKIIRPFSNPIKETGHIQILRGSLAPGGCVGKITGKEGTVFTGKARVFNHEDDFIAALERKEITKDEQTVVVIRYTGPKGGPGMPEMLKPSSALMGAGLGQTCALITDGRFSGGSHGFLIGHIVPEAAVGGPIGLVHDGDVITIDAEKRVLDLDVDEAELAKRRKQWEADKAAGKLPQTGLNLRGTLGKYARNVKDASSGCITDAFD

SEQ ID NO: 439 - DNA, 1848 bp, Aspergillus oryzae
atgcttctttcacaaacccgggggcgtatgccctctgctctgcggagcctctccaggcggtccgccgtcaatgttcgtcccctctctaccaccctccccaagcaaaaggcctcttcctccgaagacgacaacgctctgaacaaggtctcccgccatgtcacacagcccatctcgcagggtgcttcccaggccatgctttacgctaccggtctcaccgaggaggacatgaacaaagctcaagtcggtatctcctccgtttggtatagcggtaacccctgtaacatgcatctgctcgatctcaaccaccgcgtcaagcaaggtgtggaacaggcaggcttgatcggcatgcagttcaacaccgtcggtgtcagtgatgcaatcagtatgggtacgaagggtatgcgatattctcttcagagtcgtgatctgattgccgactctatcgagactgttatgggtggtcagtggtacgatgccaacatcagtatcccgggttgcgacaaaaacatgcccggtgtgttgatggccatgggcagagtcaaccggccgagcattatgttgtacggaggcaccatcaagcccggttgtgccgctacccaaaacaatgccgagattgacatcgtctccgcattccaggcctacgggcagttcctgagcggcgacattaccgagcctcagcgatttgatattatccgtaacgcttgcccaggaggcggtgcctgcggtggtatgtacacggccaacaccatggccaccgccattgagaccattggtatgaccctccctggctcttcttccaaccccgccgagtcccgcgccaaggaccttgagtgtctggctgttggtggggcgatcaagaagcttctgaaggaggacatccgccctagggatattatgacccgccaagctttcgaaaacgccatggttgtggtgaacatcaccggtggctcgaccaacgctgtgctgcacttgattgccatcgctgattcggtcggcatcaagctggatattgaggacttccagtccgtctccgaccgtattcctttcttggctgatctgaagccatcgggcaagtacgtcatggccgacatgcacaagatcggaggtacccccgcactgctcaagttcctgctcaaggaaggcctcatcgatggttccggcatgactgtcaccggtgagactctagccaagaacctcgagaaggttcccgatttccccgaagatcagaagatcatccgccctctgtccaaccccatcaaggagactggccatatccagattctgaagggatccctggctccgggtggcagtgttggtaagatcactggcaaggagggtacttctttcactggtaaggcacgtgtcttcgatgatgaggatgatttcatcgctgctctggagcgtggtgagatcaaaaaggaggacaagactgttgtggttatccgctacaccgggcccaaggggggtcctggtatgcccgaaatgttgaagccctcttctgcccttatgggctatggtctcggacagtcggttgccctcatcaccgatggacgtttctccggcggctctcatggcttcctgatcggacacattgtccctgaggctgctgttggtggacctattggtctcgtcaaggatggtgatgtcatcgtcattgatgctgagaagcgcgttctcgaccttgaggttgaccaggagactctcgccgagagacgcaagcagtgggaagccgataaggaggccggcaagctgcctcccaccggtctgactatgagaggaaccctcggcaagtacgctaggaccgtcaaggatgccagccacggctgtatcaccgatgctcttgattaa

SEQ ID NO: 440 - protein, 615 aa, Aspergillus oryzae
MLLSQTRGRMPSALRSLSRRSAVNVRPLSTTLPKQKASSSEDDNALNKVSRHVTQPISQGASQAMLYATGLTEEDMNKAQVGISSVWYSGNPCNMHLLDLNHRVKQGVEQAGLIGMQFNTVGVSDAISMGTKGMRYSLQSRDLIADSIETVMGGQWYDANISIPGCDKNMPGVLMAMGRVNRPSIMLYGGTIKPGCAATQNNAEIDIVSAFQAYGQFLSGDITEPQRFDIIRNACPGGGACGGMYTANTMATAIETIGMTLPGSSSNPAESRAKDLECLAVGGAIKKLLKEDIRPRDIMTRQAFENAMVVVNITGGSTNAVLHLIAIADSVGIKLDIEDFQSVSDRIPFLADLKPSGKYVMADMHKIGGTPALLKFLLKEGLIDGSGMTVTGETLAKNLEKVPDFPEDQKIIRPLSNPIKETGHIQILKGSLAPGGSVGKITGKEGTSFTGKARVFDDEDDFIAALERGEIKKEDKTVVVIRYTGPKGGPGMPEMLKPSSALMGYGLGQSVALITDGRFSGGSHGFLIGHIVPEAAVGGPIGLVKDGDVIVIDAEKRVLDLEVDQETLAERRKQWEADKEAGKLPPTGLTMRGTLGKYARTVKDASHGCITDALD

SEQ ID NO: 441 - DNA, 1836 bp, Ajellomyces capsulatus
atgctccgattacaagcacggggccggatgcccaactgcttcaaaagactgcttttcccattgtcctgtcgagctctctccgcaactccatacccatattcatcttcgtcctcacaggagaagaagctcaacagtgtttcccaacatgtaacgcaacccatttcccaaggtgcctcacaggccatgctttacgctacgggcctaatgccggaggatatgtcgaaagctcaagttggcatctctagcgtctggtacaacggaaacccctgcaacatgcatctcctcgatctcagcaaccgtgtgcgcgaaggtgtgcaaaaggcgggactcataggttaccagttcaacactgttggcgtcagtgacgctatcagcatgggtacgtcaggtatgcggtacagtttgcagagtcgggatctcatcgcggactcgattgagacggtcatgggtggtcaatggtatgatgctaacatcagcatccccgggtgtgacaagaatatgcctggcgtggttatggcaatgggaagagtaaaccggccaagtttgatggtttatggcggaacaattaagcccgggtgcgcggtaacccaaaacaacgccgatatcgacatcgtgtctgcgttccaggcttacggccaattcataactggtgagatcactgaggctcagcgatacgacatcatccgacatgcttgccctggcggtggtgcttgtggggggatgtacactgcaaacaccatggcgtctgcgatcgaagttatgggaatgacgttaccgggatcttcatcgaaccctgcagaatccaaagccaaggatctagaatgcctgacggctggggaagcaattaaaacccttctcaaggaggatatccgtcccactgacatcttgacgcgccaggcctttgaaaatgcaatggttcttgtcaacatcaccggcggctccaccaacgcagtgctccatctgatcgctatagctgactctgtcggaattaaactcacaattgacgatttccagtcagtcagtgaccgcatccccttcctcgcagatctcaagccttccggtaaatatgttatggccgatcttcatacaattggtggtactccctcattactcaagttcctcttgaaggagggtctcatcgacggctctggaattaccgtgactggtcaaaccctggccaagaacctcgagaaggttcctgaattcccttcagatcagaaaatcattcgacccctcaacaaccccatcaagaaaactgggcacatccagatcctccgcggaagcctcgcccctgaaggcagcgtcggcaaaattacaggaaaggagggtaccaagttcactggcaaggcgaaggtctacgatcatgaagacgattttattaccgcattagaacagaatgagatttcgaaggacgagaagacagtcgtggtaattcgttacactgggcccaagggtggtccgggaatgcctgaaatgctcaagccttcctccgcccttatgggcgcggggctaggttcatccgtcgccttgatcacagacggccgtttcagtggtggctctcatggcttcctgatcggccacatcgttcccgaagccgcagtcgggggccctattgcgctcgtccacgatggcgatgtcatcaccattgacgccgaaaaacgtttgctcgaccttgacgtctccgaacacatcctagctcagcgtaggaaggaatgggccgatagggagagtaaaggactaaatcccgttacgggaatgaaaatgagagggacgctgggaaaatatgctagatctgtcaaggacgcaagtcacggatgcatcaccgacgcattatag

SEQ ID NO: 442 - protein, 611 aa, Ajellomyces capsulatus
MLRLQARGRMPNCFKRLLFPLSCRALSATPYPYSSSSSQEKKLNSVSQHVTQPISQGASQAMLYATGLMPEDMSKAQVGISSVWYNGNPCNMHLLDLSNRVREGVQKAGLIGYQFNTVGVSDAISMGTSGMRYSLQSRDLIADSIETVMGGQWYDANISIPGCDKNMPGVVMAMGRVNRPSLMVYGGTIKPGCAVTQNNADIDIVSAFQAYGQFITGEITEAQRYDIIRHACPGGGACGGMYTANTMASAIEVMGMTLPGSSSNPAESKAKDLECLTAGEAIKTLLKEDIRPTDILTRQAFENAMVLVNITGGSTNAVLHLIAIADSVGIKLTIDDFQSVSDRIPFLADLKPSGKYVMADLHTIGGTPSLLKFLLKEGLIDGSGITVTGQTLAKNLEKVPEFPSDQKIIRPLNNPIKKTGHIQILRGSLAPEGSVGKITGKEGTKFTGKAKVYDHEDDFITALEQNEISKDEKTVVVIRYTGPKGGPGMPEMLKPSSALMGAGLGSSVALITDGRFSGGSHGFLIGHIVPEAAVGGPIALVHDGDVITIDAEKRLLDLDVSEHILAQRRKEWADRESKGLNPVTGMKMRGTLGKYARSVKDASHGCITDAL

SEQ ID NO: 443 - DNA, 1845 bp, Coccidioides immitis
atgcttcagctaaggcctcgcgggcatatgccctacaggcaattgctcacttatctctctcaccgtgccttttcttccagatcgacgttccagcagaagtcttcgtcgaatcccccgtcaaaatcaggaaagccattaaatgaagtatccagccatatcacgcagccaatctcccagggcgcttcccaggctatgctttacgctaccgggctttcgacggacgacatgtccaagcctcaggtcgggatctccagtgtctggtacaatgggaatccctgcaacatgcacctcctggacctaagcaacatcgtgcgggaaggcgtgcaaaaggcaggattgatcggatatcaattcaacaccattggtgttagtgacggaattagcatgggaacaaaaggaatgagatacagcttgcagagcagagacctaatcgccgattccatagagaccgtcatgggtggtcagtggtacgacgcaaatatcagtctgccgggatgcgataaaaacatgccgggagttatcatggctatgggtcgtgtgaaccggccgagtttgatggtatatgggggaacgatcaggccgggctgtgctgcaacacaaaacaatgctgatatcgatatcgtgtccgccttccaggcatacggccaattcttgactggggagatctccgaggagcagcgatttgatattatccgccatgcctgccctggtggtggtgcatgtggtggaatgtacaccgcaaacaccatggcttcggctatcgaggtcatgggaatgacccttccgggctcttcctccaacccagcagaatctaaggcaaagaaggccgaatgtctggctgcgggcgaagccatcaagaaccttctcatcgaggatattcgaccatccgacatcctcaccaggaccgcatttgaaaacgccatgatcttggtgaacatcactggaggctccaccaacgcggtcctccacctcattgccatggccgactccgtcggcatcaaactcaccattgatgacttccaggccgtcagcgatcgtaccccgttcctcgcagaccttaagccatccggaaagtacgtcatggctgatctgcacaacattggcggcaccccatccctgattaaattcctactgaaggagggtgtcctcgacggttcgggaatgactgttaccggtcagaccttggccaagaacgtagagaatgtccctgacttcccatctgaccaaaagatcatccgacctttcagcaacccaatcaagaagaccggccatcttcaaatcctccgtggcagcctcgctcctgaggggagtgtaggcaagatcacaggcaaagaaggaacaagtttcacaggcaaagctagagtgtatgacgatgaagatgattttattgcctctttggaacgaaacgaaattaaaaaggaagagaaaactgtcgttgttatccgatatactggaccgaagggaggaccaggaatgccagagatgcttaagccttcttctgccctgatgggtgccggattgggctcttctgttgccctcatcacggacgggcgtttcagtggtggttctcatggcttcttgatcggacacatcgtccctgaagccgcggttggcggaccaatcgccctcgttgaagacggcgacatcatcaccatcgacgccgagaagcgagttctcgatcttgaagtcggtgaagacgttctcgcgcaaagaaggaagaagtggcaggagaaacaggaggcaggcctcggtcgtccaactggattgacgatgaggggaactctgggtaaatatgccagagctgtgacggatgctagtcatggatgtatcaccgacggtgtatga

SEQ ID NO: 444 - protein, 614 aa, Coccidioides immitis
MLQLRPRGHMPYRQLLTYLSHRAFSSRSTFQQKSSSNPPSKSGKPLNEVSSHITQPISQGASQAMLYATGLSTDDMSKPQVGISSVWYNGNPCNMHLLDLSNIVREGVQKAGLIGYQFNTIGVSDGISMGTKGMRYSLQSRDLIADSIETVMGGQWYDANISLPGCDKNMPGVIMAMGRVNRPSLMVYGGTIRPGCAATQNNADIDIVSAFQAYGQFLTGEISEEQRFDIIRHACPGGGACGGMYTANTMASAIEVMGMTLPGSSSNPAESKAKKAECLAAGEAIKNLLIEDIRPSDILTRTAFENAMILVNITGGSTNAVLHLIAMADSVGIKLTIDDFQAVSDRTPFLADLKPSGKYVMADLHNIGGTPSLIKFLLKEGVLDGSGMTVTGQTLAKNVENVPDFPSDQKIIRPFSNPIKKTGHLQILRGSLAPEGSVGKITGKEGTSFTGKARVYDDEDDFIASLERNEIKKEEKTVVVIRYTGPKGGPGMPEMLKPSSALMGAGLGSSVALITDGRFSGGSHGFLIGHIVPEAAVGGPIALVEDGDIITIDAEKRVLDLEVGEDVLAQRRKKWQEKQEAGLGRPTGLTMRGTLGKYARAVTDASHGCITDGV

SEQ ID NO: 445 - DNA, 1830 bp, Botryotinia fuckeliana
atgctctcacaattgagaacgagggcaaatgcctctcttctcacctcaagaagagcttcacaatatgtgcgctctctatcgtccacatcctctctccgcacatcctccaatgactcagaaccacagctcaacagaacctcagctgctatcacacaaccaaaatcacaaggtgcttcgcaggcaatgttatatgccactggtatgaccgaggaaagattaaacaaagcacaagttggtatctcttcagtatggtggtcgggaaatccttgcaacatgcatcttttggaactcaaccacaaagtaaaggaaggagtagagagagccggtttggtaggatatcaattcaacaccattggagtttcggacggtatttctatgggtacaaagggtatgagatacagtcttcagtcaagagatttgattgcggatagtattgaaactgtgatgggtggtcaatggtatgatgccaacatttcgattcctggatgtgacaagaacatgcctggtgttatgatggcaattggcagagtcaacagaccagcccttatggtttatggtggttctattaaaccagggtgtgccgcaacacaaaacaacgcagatatcgatattgtctccgcattccaagcctacggacaattcattactggagagattacagaagaacaaagattcgatgttattcgtcatgcttgcccaggtcaaggtgcatgtggtggaatgtataccgcaaacaccatggcatcagctatcgaaattatgggaatgactcttcctggatcttctaccaaccccgcagattcaaaggccaaattacttgaatgctacgcagctggtggtgcaatcaaaactcttctcaaggaggacatcagacctagagatatcatgacaagacaggctttcgaaaatgctatggttcttgttaccattactggaggatctaccaacgctgttcttcatcttattgctatggcagatgctgtaggaatcaagctcacaatcgatgatttccaagctgtttctgaccgaacacctttcctcgcagacctcaaaccatctggtaaatacgtcttcaatgatctttacagcatcggtggtactccttctcttatcaaactcctcatcaaggaaggtgtcattgatggatcaggaatgactgttactggtaagacccttgctgagaacgtcaaggatgttcgtgatttcccatccgaccaagaaattattcgcccattctcaaaccccatcaaaaagtctggtcacattcaaattctccgcggttccctcgcaccaggtggatccgttggtaaaatcaccggtaaagaaggattacgattcgttggaaaagctaaggtttatgatgctgaaaatgatttcatcgaagcccttgagcgtggcgaaatcaagaagggagagaagaccgttgtagtcattcgttatgaaggaccaaagggtggaccaggtatgccagaaatgttaaaaccatcctcggcaatcatgggtgcaggacttggaaaggatgtcgctcttattaccgatggacgtttcagtggaggatctcatggattcttgattggacatattgtaccagaggcacaagtcggtggaccaattggattggttagggatggtgatactattgttattgatgctgagacgagagtattggatttggaagttgagggtggtgaggaggaattggagaggaggagaaaagaattcgtcgcacctcctttgaaatataccaagggtactttggcgaaatactcgagattggtacaagatgctagtcatggatgtattaccgatggagaaatcgttgaggcatga

SEQ ID NO: 446 - protein, 609 aa, Botryotinia fuckeliana
MLSQLRTRANASLLTSRRASQYVRSLSSTSSLRTSSNDSEPQLNRTSAAITQPKSQGASQAMLYATGMTEERLNKAQVGISSVWWSGNPCNMHLLELNHKVKEGVERAGLVGYQFNTIGVSDGISMGTKGMRYSLQSRDLIADSIETVMGGQWYDANISIPGCDKNMPGVMMAIGRVNRPALMVYGGSIKPGCAATQNNADIDIVSAFQAYGQFITGEITEEQRFDVIRHACPGQGACGGMYTANTMASAIEIMGMTLPGSSTNPADSKAKLLECYAAGGAIKTLLKEDIRPRDIMTRQAFENAMVLVTITGGSTNAVLHLIAMADAVGIKLTIDDFQAVSDRTPFLADLKPSGKYVFNDLYSIGGTPSLIKLLIKEGVIDGSGMTVTGKTLAENVKDVRDFPSDQEIIRPFSNPIKKSGHIQILRGSLAPGGSVGKITGKEGLRFVGKAKVYDAENDFIEALERGEIKKGEKTVVVIRYEGPKGGPGMPEMLKPSSAIMGAGLGKDVALITDGRFSGGSHGFLIGHIVPEAQVGGPIGLVRDGDTIVIDAETRVLDLEVEGGEEELERRRKEFVAPPLKYTKGTLAKYSRLVQDASHGCITDGEIVEA

SEQ ID NO: 447 - DNA, 1692 bp, Phaeosphaeria nodorum
atgtctctcgcacgctttggaggcgcactttcacgtcccaagtcgcagggcgcctcgcaggccatgctgtacgcgactggcatgagcgaggatgatatgaataaggcccaggtcggcatctcatcagtgtggtactcgggcaacccatgcaatatgcacctgatggacctcaacaacaaggtcaaagagggtgtgcagcgggctggtctcttgggcatgcagttcaacaccattggtgtgagtgacggcatttccatgggcaccaagggcatgcgctactcgctgcagtcgcgtgagatcatcgcagactcgattgagactgtcatgggcggccaatggtacgatgcgaacatttccatccccggatgcgacaagaacatgcccggtgtcatcatggctatgggccgtgtgaaccggccctcgctgatggtctacggcggaaccatccagcctggatgcgcaaagactctcgacaaccagtccatcgacatcgtctctgccttccaggcctacggacaattcataactggagagatcactgaagaccagcgcttcgatgtcatcagacacgcatgcaacggtcagggtgcttgtggaggcatgtacacggcaaacacaatggctactgccattgagaccatgggcatgtcgctgcccggctcatcgtcgaaccccgccaactcgcaggccaagatgctggaatgcctggctgcgggaggcgcaatcaagaacctgctcaaggaggacctgcgccccagcgacatcctcaccaggcaagcactcgagaacgccatggttgtcatcagcatcaccggaggctccaccaacgccgtattacacctgatcgccatcgccgactctgttggtctcaaactgaccatcgacgacttccagagcgtgagcgaccggattccgttgctcgctgatctcaagccctctggcaagtacgtcatggctgatgttcacgacatcgggggtactcccgcactgctcaagttcctgcttaaggagggcctgctcgacggcagccagatgactgtcactggcaagaccctaaagcagaacttggagaacgtcaaggacttcccctccgaccagaagatcatccgccctctcagcgagcccctcaagactaccggccatttgcaaattctccgtggtagtctcgcaccaggtggctgtgtcggcaagatcaccggcaaagaaggaaccatcttcaccggcaaagccaaatgctacgatgccgaagacgacttcatcagtgcgctcgagcgcggcgagatcaaaaagggcgagaagactgtcgtcgtcatccgctacgaaggccccaagggcgggcccggcatgcctgaaatgctcaagcccagctccgccatcatgggcgcaggtctcggcaaggatgtcgcactcatcactgacgggcgcttcagcggtggtagccacggtttcttgatcggccacattgtgcctgaagcgcaggagggcggaccgatcggtcttgtccaggatggcgatgagatcaccatcgactctgagtcgaatgaacttaacattggcgtgagcgagcaggagttggcggagcgcaggaagagctggaaggcgccggcgctgaagtatcaaaagggcacgctgttcaagtatgcgcggttcgtcaaggacgccagctcgggatgcgtgacggactcggcataa

SEQ ID NO: 448 - protein, 563 aa, Phaeosphaeria nodorum
MSLARFGGALSRPKSQGASQAMLYATGMSEDDMNKAQVGISSVWYSGNPCNMHLMDLNNKVKEGVQRAGLLGMQFNTIGVSDGISMGTKGMRYSLQSREIIADSIETVMGGQWYDANISIPGCDKNMPGVIMAMGRVNRPSLMVYGGTIQPGCAKTLDNQSIDIVSAFQAYGQFITGEITEDQRFDVIRHACNGQGACGGMYTANTMATAIETMGMSLPGSSSNPANSQAKMLECLAAGGAIKNLLKEDLRPSDILTRQALENAMVVISITGGSTNAVLHLIAIADSVGLKLTIDDFQSVSDRIPLLADLKPSGKYVMADVHDIGGTPALLKFLLKEGLLDGSQMTVTGKTLKQNLENVKDFPSDQKIIRPLSEPLKTTGHLQILRGSLAPGGCVGKITGKEGTIFTGKAKCYDAEDDFISALERGEIKKGEKTVVVIRYEGPKGGPGMPEMLKPSSAIMGAGLGKDVALITDGRFSGGSHGFLIGHIVPEAQEGGPIGLVQDGDEITIDSESNELNIGVSEQELAERRKSWKAPALKYQKGTLFKYARFVKDASSGCVTDSA

SEQ ID NO: 449 - DNA, 1758 bp, Pichia guilliermondii
atgttatctgctagagtacattctagactattttccacttcggtggtccgttgtgagaaagtgctcaacaagtactcttcgatcgtgacccaggataagtctcaaggtgcttcgcaagccatgttgtatgctacgggctttcaagatgaagatttcgataaggctcaaattggagttggaagtgtatggtggtcaggaaacccttgtaatatgcacttgatggacatgaacgacagatgtacagcttctgtgaacaaggctggattgaaaggaatgcaattcaattccattggagtttctgatggtatcaccaacggtactgatggtatgagatattcattacaatcgagagaaatcattgccgattcatttgagactttagtgatggcccagatgtatgatggtaacattgccattccatcgtgtgacaagaatatgcctggtactcttatggctatgggtagacacaatcgtccatcgattatggtttatggtggtactatcatgcctggatctccttcttgtggtggtgcaaatgttcctgagaagattgatatcattagtgctttccaatcttatggtcaatttttgagtggacagatcaatgaggaacaaagaaaggacattgtaagacatgcttgtccaggtgctggtgcttgtggtggtatgtataccgccaacaccatggcttctgctgctgaggtcatgggtatgtcacttccatactcttcttcagctcctgccatttcgaaagaaaaagctgatgagtgtgacaatgttggttatgccatgaaacatttattagaaattgatttgaaacccaaggatataatgactaaaaagtcctttgagaatgccatcacctacatcattgccactggtggttccacaaatgcggtgttgcacttgattgccattgctcattctgtgggtattgacttgactgttgatgacttccaacgtatttctgataccactccattgttggctgatttcagaccatctggtaaatacgttatggcagatcttcaacaatttggaggtactcctgcggtgatgaaattgttgttggaagaaggtttcctcgatggagaccagtacaccgtcaccggtaataccatcaaagaaaacttatcaaaggtcaagggattgccagccagtcaagacattgttcgtcctgtttctaacccattgaaaccaaatggacacttgcaaattctcaagggtactttagcaccaggaagtgccgttggtaagattactggtaaagaaggtacctactttaagggagctgccagagtgtttgacaatgaagaattgttcatcaaggctcttgaaaagggagagatcaagaagggagaaaagaccgtttgtgtgattcgttatgagggccctaagggtggtcctggtatgcccgaaatgttgaaaccttcttcagcattgatgggttatggtttgggtaaagacgttgcattgttgactgatggtaggttctctggtggttctcatggtttcttgattggtcacatcgtgccagaagccgccgagggtggcccaattgccttggttcacgacggagatgagattgtcattgatgctgaaaacaacaaaattgacttgcttgtctcggaagaaattctcgctgaaagaaagaagctgtggtctcctcctgctccaagatacacgagaggaaccttggccaagtactccaaattggttagtgatgcttccaccggttgtgtaactgacttggactaa

SEQ ID NO: 450 - protein, 585 aa, Pichia guilliermondii
MLSARVHSRLFSTSVVRCEKVLNKYSSIVTQDKSQGASQAMLYATGFQDEDFDKAQIGVGSVWWSGNPCNMHLMDMNDRCTASVNKAGLKGMQFNSIGVSDGITNGTDGMRYSLQSREIIADSFETLVMAQMYDGNIAIPSCDKNMPGTLMAMGRHNRPSIMVYGGTIMPGSPSCGGANVPEKIDIISAFQSYGQFLSGQINEEQRKDIVRHACPGAGACGGMYTANTMASAAEVMGMSLPYSSSAPAISKEKADECDNVGYAMKHLLEIDLKPKDIMTKKSFENAITYIIATGGSTNAVLHLIAIAHSVGIDLTVDDFQRISDTTPLLADFRPSGKYVMADLQQFGGTPAVMKLLLEEGFLDGDQYTVTGNTIKENLSKVKGLPASQDIVRPVSNPLKPNGHLQILKGTLAPGSAVGKITGKEGTYFKGAARVFDNEELFIKALEKGEIKKGEKTVCVIRYEGPKGGPGMPEMLKPSSALMGYGLGKDVALLTDGRFSGGSHGFLIGHIVPEAAEGGPIALVHDGDEIVIDAENNKIDLLVSEEILAERKKLWSPPAPRYTRGTLAKYSKLVSDASTGCVTDLD

SEQ ID NO: 451 - DNA, 1782 bp, Debaryomyces hansenii
atgagtgcattgacaaagtgtaaacgtaacttaggaggtagaaacatccggttattttccaattctgctttgaattgtgacaacaagttaaataagtactcttctattgtgacccagcccaagtcgcaaggggcatcccaagcgatgttgtatgcgaccgggtttgatgaagaagatatgaacaaggcacaggttggtgttggatctgtctggtggtcaggaaatccgtgcaacatgcacttgatggagatgaacaacaaggtgaccgaatctgttaacagagccggtttgaaggggatgcagttcaactcgattggtgtctcggatgggatcactaatggtactgatggtatgagatactcgttgcaatcgcgtgaaattattgctgactcgtttgagaccatgatgatggcccagatgtacgatgccaacatcgcaattccgctgtgtgacaagaacatgccaggtaccttgatggctatgggtagacacaacagaccatctattatggtttacggtggtactattatgccaggttctccaacttgtggtaactcgattattcctgacaagattgatatcatctctgcgttccaatcgtatggtcaattcttatcggaccagatcaatgagggcgaaagaaaggatatcattaagaatgcatgtcctggtgctggtgcatgtggtggtatgtacactgccaacaccatggcctctgctgctgaagttttaggtatgtccttaccattttcgtccagtgccccagccatttcgaaggaaaaggcacatgaatgtgctactgtcggtgatgccatcaagaatttgttagtccttgacttgaagccaatggatatcatgaccaagaaggcttttgaaaatgcaatcacttatattatcgctactggtggttctactaatgccgttttacatttgattgccatggcaaacaccgttggtgttgacttaactgtcgatgatttccaaagaatttcggactccactccattattagccgatttcaagccaagtggtaagtacgttatggctgacttacaaaagtacggtggtaccccagctgtcatgaagttgttattcgaggaaggtttaattgatggatctcaatatactgtcacaggtaagactatcaaagaaaatttggaatctgttaaaggcttgccagctgaacaagaaattgtcagacccttatctaacccattaaagccaagtggccacttacaaattttaaagggtactttagctccaggtagtgctgtcggtaaaattactggtaaggaaggtacttatttcaagggtaaatctagagttttcgatgatgaaatggcattcattactgctttagaaaatggcgaaatcaagaaaggtgaaaagactgtttgtgtcattagatacgaaggtcctcaaggtggccctggtatgccagagatgttgaagccttcttctgcattaatgggttacggtttaggccaagacgttgcgttattaactgatggtagattctctggtggctctcatggtttcttaattggtcatattgttccagaagctgcagttggtggaccaattgcgttagtgcatgatggtgatgaaattgttattgacgctgaaaacaatagaatcgacttattagtatctgaagatattttagccgaaagaaagaaggaatggaccccaccaaagccaagatatacaagaggtacattggctaaatattctaagttagtcagtgatgcttcgttgggttgtgttactgatttggtataa

SEQ ID NO: 452 - protein, 593 aa, Debaryomyces hansenii
MSALTKCKRNLGGRNIRLFSNSALNCDNKLNKYSSIVTQPKSQGASQAMLYATGFDEEDMNKAQVGVGSVWWSGNPCNMHLMEMNNKVTESVNRAGLKGMQFNSIGVSDGITNGTDGMRYSLQSREIIADSFETMMMAQMYDANIAIPLCDKNMPGTLMAMGRHNRPSIMVYGGTIMPGSPTCGNSIIPDKIDIISAFQSYGQFLSDQINEGERKDIIKNACPGAGACGGMYTANTMASAAEVLGMSLPFSSSAPAISKEKAHECATVGDAIKNLLVLDLKPMDIMTKKAFENAITYIIATGGSTNAVLHLIAMANTVGVDLTVDDFQRISDSTPLLADFKPSGKYVMADLQKYGGTPAVMKLLFEEGLIDGSQYTVTGKTIKENLESVKGLPAEQEIVRPLSNPLKPSGHLQILKGTLAPGSAVGKITGKEGTYFKGKSRVFDDEMAFITALENGEIKKGEKTVCVIRYEGPQGGPGMPEMLKPSSALMGYGLGQDVALLTDGRFSGGSHGFLIGHIVPEAAVGGPIALVHDGDEIVIDAENNRIDLLVSEDILAERKKEWTPPKPRYTRGTLAKYSKLVSDASLGCVTDLV

SEQ ID NO: 453 - DNA, 1794 bp, Lodderomyces elongisporus
atgagtttcgctagcaccacaagaaggtgttgcactagatcttttgcctcctccactgttcgtcatgaattagaaaagaaaccattgaaactcaacaagtactcttccgttgtcaccgaggacccttcccaaggagcatcgcaagcaatgctctacgccacagggttctcctccgaggactttaaccgtgcacaaatcggtgtcggatccgtttggtggaccggtaacccttgtaacatgcacttgatggagttaaacaatatgtgtgcagagtcagtcaacaaggccggtttaaaagcaatgcaattcaactcaattggtgttagtgatggtatcaccaacggtacagagggtatgaaatactcattgcaatcacgtgaaatcattgctgactcatttgaaacaatgaccatggctcaattatatgacggtaatgttgccatcccaagttgtgacaagaatatgcccggtgtccttatggcaatgggtagacacaatagacccgccattatggtgtacggaggtacaatcatgcccggctcaccaacttgcggtggctcaaagctgaatcccgccattgcagataagattgacattatcagtgctttccaaagttatggacaattcttgtccaaacaaatcaacgaggaagaaagaattgatattgtgaaaaacgcatgtcctggaccaggtgcttgcggtggtatgtacactgccaacactatggcctctgcagccgaagtcttgggtttaactttacctttttcatcatcggcaccagcagtttcaaaagaaaaggccgaagagtgtgccaacgttgggtacgccatcagaaacttgcttgaactcgacttgaaaccaagagacattttgaccaaaaaatcatttgaaaacgccatcacatacatcattgctaccggtggctcaacaaatgcagttttgcacatgattgccattgcttcaagcttcgatatcgaattaactgttgacgatttccaaagaatcagtgactctactccacttttggctgactttaaaccatctggtaaatacgttatggcagatttgcaagctattggtggtacaccagcagttatgaagtttttgatgaatgaaggtatgattgatggttcgcaattgactgtgacaggtaagaccattgctgaaaacttggccaatgttccagaattgccaaagggtcaagaaatcatccactcattggacaacccattgaaaccaagcggtcacttgcaaatcttgaaaggaaccttggccccaggctcagccgttgccaagattactggtaaagaaggtacttacttcaaaggtaaagctagagtttttgacgaggaacacgcatttatcactgcattggaaaatggcgagatcaaaaagggtgaaaagactgtttgtgtcattagatacgaaggaccaaaaggtggtccaggtatgccagaaatgttgaaaccatcaagtgctttgatgggatacggattgggacaagatgttgccttattgaccgatggtagattttctggtggttcacacggattcttgattggtcacattgtccccgaggcagccgaaggtggtccaattgctcttgttgaggatggcgatgagattgttattgatgccgacaagaacatcattgacttgttggtgagcgaagacgtcttggccaagagaagagagcaatggactccacctgaacccagatacaaaagaggtacattgttcaaatatgccaaattggttagtgatgcttccaaaggatgtgttactgacttgtaa

SEQ ID NO: 454 - protein, 597 aa, Lodderomyces elongisporus
MSFASTTRRCCTRSFASSTVRHELEKKPLKLNKYSSVVTEDPSQGASQAMLYATGFSSEDFNRAQIGVGSVWWTGNPCNMHLMELNNMCAESVNKAGLKAMQFNSIGVSDGITNGTEGMKYSLQSREIIADSFETMTMAQLYDGNVAIPSCDKNMPGVLMAMGRHNRPAIMVYGGTIMPGSPTCGGSKLNPAIADKIDIISAFQSYGQFLSKQINEEERIDIVKNACPGPGACGGMYTANTMASAAEVLGLTLPFSSSAPAVSKEKAEECANVGYAIRNLLELDLKPRDILTKKSFENAITYIIATGGSTNAVLHMIAIASSFDIELTVDDFQRISDSTPLLADFKPSGKYVMADLQAIGGTPAVMKFLMNEGMIDGSQLTVTGKTIAENLANVPELPKGQEIIHSLDNPLKPSGHLQILKGTLAPGSAVAKITGKEGTYFKGKARVFDEEHAFITALENGEIKKGEKTVCVIRYEGPKGGPGMPEMLKPSSALMGYGLGQDVALLTDGRFSGGSHGFLIGHIVPEAAEGGPIALVEDGDEIVIDADKNIIDLLVSEDVLAKRREQWTPPEPRYKRGTLFKYAKLVSDASKGCVTDL

SEQ ID NO: 455 - DNA, 1764 bp, Vanderwaltozyma polyspora
atgactattgcaagcaaggcattgagtgctagacacttttcagtcactagaaatgttagtaagaagttgaataagtactcttatatcgttacagaacctaaggaccaaggtgcatcacaagcgatgctttatgcaactgggttcaagaaagaagattttagtaaaggtcaagttggtgtaggatcatgttggtggtctggtaatccatgtaatatgcatttattggatcttaatgatagatgttcacgttctgtggagaaggctggcttgaaagctatgcaatttaataccattggtgtttccgatggtatttcaatgggtactaaaggtatgagatactctttacagagtagagaaatcattgctgattcttttgaaactataatgatggctcaacattacgatgccaatattgctatcccttcatgtgataaaaacatgccgggtgtcatgatggccatgggaagacataacagaccttctatcatggtttatggtggtactattttacctggccatccaacctgtggttcttcaaaaattccagaaaacattgatatagtatctgctttccaatcttatggtcaatatatatctaaacaattcagcgaacaagagagagaagatgtggttgaacatgcttgtcctggtccaggttcttgtggtggtatgtatactgctaacactatgggttctgtcgcagaagtgctaggtttgactttgccaaactcttctgccttcccagcagtttctcaagaaaagatgaatgaatgtgattccattggtgaagctattaagaagacaatggaattaggtatcactcctcgtgatatcatgactaagcaagcttttgaaaatgcaatcacctatgttatcgcaaccggtggttccaccaatgctgttttgcacttggttgccattgctcattctgctggtgtcaagattactcctgatgatttccaaagaatcagtgataagaccccattattgggtgattttaaaccatcgggtaaatacgttatggctgatttaatcaaagtaggaggtacccaatctgttatcaaattcttgtacgaaaacggtttcttgcatggtgatgccattactgttactggtgatacattagccgaacgtgctgccaaaacttctggattaccagaaggccaagatataatcagacctgtttcacaacctattaaaccaaatggccatctacaaatattgtatggctcattggctccaggtggtgctgtcggtaaaatcactggtaaagaaggtactttctttaaaggtagggctcgtgtttttgaagaagaagaagctttcattcatgcattggaaagaggtgaaattaagaaaggtgaaaaaaccgttgttgtcatcagatatgaaggtccaaaaggtggtccaggtatgccagaaatgttgaaaccatcctctgcgctaatgggttacggtttaggtaaagatgttgccttgttaactgatggtagattttctggtggttcccatggattcttaatcggtcacattgttccagaagctgccgaaggtggtccaattggtttagttaaagatggagacgaaattgttattgatacaaataacaacaagatagatttattagtatccgaacaagaaatagcccaacgtaaatcagagtgggttaaaccagctccacgttacaccagaggtactctatccaagtacagtaaattggtatctaacgcttctaacggttgtgtattagacgctgacaattga

SEQ ID NO: 456 - protein, 587 aa, Vanderwaltozyma polyspora
MTIASKALSARHFSVTRNVSKKLNKYSYIVTEPKDQGASQAMLYATGFKKEDFSKGQVGVGSCWWSGNPCNMHLLDLNDRCSRSVEKAGLKAMQFNTIGVSDGISMGTKGMRYSLQSREIIADSFETIMMAQHYDANIAIPSCDKNMPGVMMAMGRHNRPSIMVYGGTILPGHPTCGSSKIPENIDIVSAFQSYGQYISKQFSEQEREDVVEHACPGPGSCGGMYTANTMGSVAEVLGLTLPNSSAFPAVSQEKMNECDSIGEAIKKTMELGITPRDIMTKQAFENAITYVIATGGSTNAVLHLVAIAHSAGVKITPDDFQRISDKTPLLGDFKPSGKYVMADLIKVGGTQSVIKFLYENGFLHGDAITVTGDTLAERAAKTSGLPEGQDIIRPVSQPIKPNGHLQILYGSLAPGGAVGKITGKEGTFFKGRARVFEEEEAFIHALERGEIKKGEKTVVVIRYEGPKGGPGMPEMLKPSSALMGYGLGKDVALLTDGRFSGGSHGFLIGHIVPEAAEGGPIGLVKDGDEIVIDTNNNKIDLLVSEQEIAQRKSEWVKPAPRYTRGTLSKYSKLVSNASNGCVLDADN

SEQ ID NO: 457 - DNA, 1746 bp, Ashbya gossypii
atgatgtctcacaggcggttctcgacagcgcagcggctgcgcgaggggctaaacaggtactcgagggtcataaccgagccgcgggcgcagggtgcctcgcaggccatgctgtacgcgactggtttcggtgatggggactttgcaaaggcgcaggtcggagtggggtcgtgctggtggtcgggcaacccatgcaacatgcatctgatggacctgaataaccgggtagcggcgtctgtggaccgggcgggcttgaaggcgatgcagttcaacacaatcggtgtctcggacggcatttctatggggactaccggcatgcggtactcgctgcagtcgcgcgagatcattgcagactcttttgagaccatgatgatgggtcagcactacgatggcaacgtggcaattccctcctgcgacaagaacatgcccggcgtgataatggccatggcgcggcacaaccggccctccattatggtctacggcggcaccatcatggcggggtccccttgcagcggctctacgcggctgccaaagaagattgatgttgtatctgcgttccaggcgtacgggcaatatctgtcgaagcagattacggaggaggaaagcagggatgtcgtccgtcacgcctgtccgggtccgggctcttgcggtggcatgtacacagccaacacaatggcctcagccgccgaggttctgggactgactctgcccaactcgtctgcgttcccggcgatctccgaacagaagctggccgaatgtgacgccgttggggatgccatgcgcaaagcgctcgagctcaacatcaggccacgcgacctgctcacaagggaagccttcgaaaacgcgatcacgtacgtgattgcgactggtggctcgaccaacgcagtgctccacctggttgctattgcccactctgcgggcgtgaaactgacgccggatgacttccagcgcatttccaacaaaactccgttgctgggcgacttcaagccatccggaaagtacgtcatggctgacctcattgaggttgggggtacacaggccgtcatcaagtttttgtatgaaaatggcttcatgcacggagatgccctaacggtgacaggagacacgctcaaggagcgggctgcgaagactgctcccttgcccgaaggccaggacatcattcgtcccgtgtcgcagccattgaatcctaggggacatctccagattctctatggctctcttgcgccaggcggcgctgtcggcaagatcaccgggaaggaggggaccttcttccagggccgcgcacgcgttttcgatgaagaaaacgcattcatccgcgccctggaggagggccagatcaagaagggtgagaaaaccgttgtggtcatcaggtatgaaggccccaagggtgggcccggcatgccagaaatgctcaaaccgtcttccgcgctgatgggctacggtctgggcaacgatgttgccttgctgaccgacggccgcttctccggcggctcccacgggtttttgatcggccacattgtccctgaggcctatgaaggcggcccaattgcgctcgtgcaagacggtgacgacattgtcatcgacgccgagaacaatgccatcaacctccttgtgccaaaagaagaaattgagtcgcgccgcgctcgctggacccagccggctccacgctacaagaggggcacgctcgccacctattctaagttagtctccaacgcctccaagggttgtgtcttggacagcgacgactag

SEQ ID NO: 458 - protein, 581 aa, Ashbya gossypii
MMSHRRFSTAQRLREGLNRYSRVITEPRAQGASQAMLYATGFGDGDFAKAQVGVGSCWWSGNPCNMHLMDLNNRVAASVDRAGLKAMQFNTIGVSDGISMGTTGMRYSLQSREIIADSFETMMMGQHYDGNVAIPSCDKNMPGVIMAMARHNRPSIMVYGGTIMAGSPCSGSTRLPKKIDVVSAFQAYGQYLSKQITEEESRDVVRHACPGPGSCGGMYTANTMASAAEVLGLTLPNSSAFPAISEQKLAECDAVGDAMRKALELNIRPRDLLTREAFENAITYVIATGGSTNAVLHLVAIAHSAGVKLTPDDFQRISNKTPLLGDFKPSGKYVMADLIEVGGTQAVIKFLYENGFMHGDALTVTGDTLKERAAKTAPLPEGQDIIRPVSQPLNPRGHLQILYGSLAPGGAVGKITGKEGTFFQGRARVFDEENAFIRALEEGQIKKGEKTVVVIRYEGPKGGPGMPEMLKPSSALMGYGLGNDVALLTDGRFSGGSHGFLIGHIVPEAYEGGPIALVQDGDDIVIDAENNAINLLVPKEEIESRRARWTQPAPRYKRGTLATYSKLVSNASKGCVLDSDD

SEQ ID NO: 459 - DNA, 1704 bp, Laccaria bicolor
atgaaccggcacagcagggtggtcacccaacccaaagaccaaggtgctagtcaggccatgctgtatgctacggacggcatcaaaacggatgatgacttcaacaaagccatggtcggcgtcgccagcgtctggtacgagggtaatccatgcaataaacatctccttggtctgggtcaagaaatcaaagcttcacttacaaagtctggtatcataggctaccagtttggtaccgttggagtcagcgatgggatcagcatgggaacgcgcggcatgtcctactccctccaatcccgagacctgattgcagatcaagtagagaccgctgccggaggacaccatctcgacgggatggtcgtcgttcccggctgcgataaaaatatgcctggtgttctgatggcccttgggcgtctcaaccgccctggacttatggtgtatggtgggacaattcgtgccgggtcgtgtgaaggagcgccacagttggacatcgtgtccgctttccagtcctacggaaagtacctgcaggacggaaagacacccgaagcggaacgcgaacgatataataccgttcgacatgcctgcccaggaccaggcgcttgtggtggtatgtacacagcaaacactatggcaagtgcggcggaggcactggggatgacagtccccggatcatcatccttcccagccgaatccctggaaaaacacaacgagtgtgcttcgattgggaaagttatgtacaaccttcttgagaaaaacatacttccacgggatatcatgactagatccgcgtttgaaaatgctatggtcctcacgatgattctaggcggttccaccaatgcagttctccatctaatagctatggctcactccgtgggcattaaattggatatcgacgacttccaaaacgtgtcagaccgcacccccttcctcgccgacatcaaacccagtggcaaatatgtcatggaagatgtgtacaagatcggtggaatcccaaaaattttggcgttcttgctaaagaacaagctaatcgacggaaataatatgactgtcacgggtcgaaccctcggcgaaaaccttgaggaatggacacacagatacggcgaactggattctcgacaagacgttattcgacctctcaacaaacccataaaagagacagggcacatccgaatcctcaaaggcaatcttgctcctggcggtgcggtggctaagatcacaggcaaagaaggcttggaatttactggcaaggcacggactttcgacacagaagacgatttcgtcaaggccgtcgaaagcgggtctatcaaaaagggtgaaaaaacggtcgtcattcttcggtatctcggccctcagggaggacctggcatgcctgagatgctgaaacccacaagcttaatcatgggagccggcttgggattggacgttgcctgtctcacagatggaagattcagcggcggatcccatgggttttgtattggacacgtcgttcccgaggcacaggttggtgggcccatagcgctcgtcagggacggagacaccattgtcgtcgatgccatcaagaacactatcgagctccgcgtctcacccgaggagttaacgaagagaaaagagtcttggattccacctgccctcaaggtatcccagggaacgttgtacaagtatactaagagtgttacagacgcgagccatgggtgtgtgacggacgcatga

SEQ ID NO: 460 - protein, 567 aa, Laccaria bicolor
MNRHSRVVTQPKDQGASQAMLYATDGIKTDDDFNKAMVGVASVWYEGNPCNKHLLGLGQEIKASLTKSGIIGYQFGTVGVSDGISMGTRGMSYSLQSRDLIADQVETAAGGHHLDGMVVVPGCDKNMPGVLMALGRLNRPGLMVYGGTIRAGSCEGAPQLDIVSAFQSYGKYLQDGKTPEAERERYNTVRHACPGPGACGGMYTANTMASAAEALGMTVPGSSSFPAESLEKHNECASIGKVMYNLLEKNILPRDIMTRSAFENAMVLTMILGGSTNAVLHLIAMAHSVGIKLDIDDFQNVSDRTPFLADIKPSGKYVMEDVYKIGGIPKILAFLLKNKLIDGNNMTVTGRTLGENLEEWTHRYGELDSRQDVIRPLNKPIKETGHIRILKGNLAPGGAVAKITGKEGLEFTGKARTFDTEDDFVKAVESGSIKKGEKTVVILRYLGPQGGPGMPEMLKPTSLIMGAGLGLDVACLTDGRFSGGSHGFCIGHVVPEAQVGGPIALVRDGDTIVVDAIKNTIELRVSPEELTKRKESWIPPALKVSQGTLYKYTKSVTDASHGCVTDA

SEQ ID NO: 461 - DNA, 1797 bp, Coprinopsis cinerea
atgccgccaaaatatctcccaattcgtcgtcaatggctccggtcagcgagaggcttgtctacaaccgcacggtgcagtgacaagcccgtcctgaaccggtacagcaggatcatcacccagcccaaggaccagggagcaagtcaggctatgctctatgctacagatggcataaagtcggacgcggacttcaacaagccgatggtcggtgtcgccagcgtatggtatgagggcaacccatgcaacaagcaccttctcggacttggccaggaaatcaaggcttcccttaccgaggcagacatcataggctaccagtttggtacggtcggtgtcagcgacggtattagtatgggtacgaaaggaatgtcgtattccctccagtcgcgagacttaatcgctgaccaggtggaaactgctgccggaggtcatcatctcgatggcatggtagtagtccctgggtgcgacaagaatatgcctggtgttctcatggctcttggccgtctcaaccgaccaggtctcatggtctacggtggaaccattcgcgcaggctcgtgtgaaggcatgcctcaattggatatcgtttctgctttccaggcctacggaaaataccttcaagacggaaggacacccaaggctgaggaagaacgatacaacaccgttcgacacgcctgtcctggtcctggtgcttgcggtggcatgtacactgcaaacacaatggcaagtgcagcggaggctttgggaatgacccttcccggttcttcctccttcccagcgcagtcagaggagaaacatctagagaccaagtctatcggttctgtgatgtacaacttgcttgagaagaacattttgccgagggacatcatgacgcgctctgcctttgaaaacgcgatggtcctcaccgtcatcctcggaggctcaaccaacgcagtcctccatttgatcgccattgctcactcagtcggcatcaaactcgacattgacgacttccaaaaggtgtccgaccggatacccttccttgccgacttgaagcccagcggaaaatatgtcatggaagatgtctacaagatcggtggtatccccaaggttctcgcgttcttgctcaagaacaatttgatcgatggtaataacatgactgttactggtcgcactgtcggagagaacttggaccgatggacgcacaagtacggcgagctccacttcgacaagcaggatgtcatccgacctctggataagcctatcaaggagactggtcacatccggattttgaagggtaacctcgcccctggtggcgccgtcgccaaaatcaccggaaaagaaggccttggtttcgtcggcaaagcacgtgtatttgattctgagaacgacttcgtcaaggctgtggaatctggtagcatcaagaagggcgagaaaaccgttgttattttgcggtatctcggtcctcagggtggacctggaatgcccgagatgcttaagcctaccagtttggtgatgggcgctggattgggtatggatgtcgccatcttgactgacggacgatttagcggaggatcgcacggattctgtatcggacacgtcgttccggaagcgcaagtcggtggccctatcgccttggtcgaggacggcgacatcatctcggttgacgctgtgaagaacacgatcgagttgcaggtccctgaacccgagcttgccgcgcgaaaggctgcatggaaggcaccccctctcaaggtcacccagggcaccctctacaaatacgccaaggttgtcaccgatgccagccatgggtgtgtcactgatgcttaa

SEQ ID NO: 462 - protein, 598 aa, Coprinopsis cinerea
MPPKYLPIRRQWLRSARGLSTTARCSDKPVLNRYSRIITQPKDQGASQAMLYATDGIKSDADFNKPMVGVASVWYEGNPCNKHLLGLGQEIKASLTEADIIGYQFGTVGVSDGISMGTKGMSYSLQSRDLIADQVETAAGGHHLDGMVVVPGCDKNMPGVLMALGRLNRPGLMVYGGTIRAGSCEGMPQLDIVSAFQAYGKYLQDGRTPKAEEERYNTVRHACPGPGACGGMYTANTMASAAEALGMTLPGSSSFPAQSEEKHLETKSIGSVMYNLLEKNILPRDIMTRSAFENAMVLTVILGGSTNAVLHLIAIAHSVGIKLDIDDFQKVSDRIPFLADLKPSGKYVMEDVYKIGGIPKVLAFLLKNNLIDGNNMTVTGRTVGENLDRWTHKYGELHFDKQDVIRPLDKPIKETGHIRILKGNLAPGGAVAKITGKEGLGFVGKARVFDSENDFVKAVESGSIKKGEKTVVILRYLGPQGGPGMPEMLKPTSLVMGAGLGMDVAILTDGRFSGGSHGFCIGHVVPEAQVGGPIALVEDGDIISVDAVKNTIELQVPEPELAARKAAWKAPPLKVTQGTLYKYAKVVTDASHGCVTDA

SEQ ID NO: 463 - DNA, 1791 bp, Cryptococcus neoformans
atgctttcaagacgcatcgctactgcaagcccagccgctcatactagagcattccatgcgtcggctgccaaggcctcgaaagaggtcataatgaatcgttactctaggactattactcaacctaaggctcaaggcgcttctcaggccatgctttacgccacggaaggcattgtgaatgacgaagacttcaataaggccatggttggcgttgccagtgtttggtacgaaggcaacccatgcaatcgacacattttgggccttggccagagggtgaagaagtctcttatgaatgctggcatcgttggctaccaatttggtactgtcggtgtctctgacggtattagcatgggtacctctggaatgtcttactccctgcaatctcgtgacctcattgccgactctgttgagacggctgctggtggtcattggctggatgggatggtcgttttacctggttgcgataaaaacatgcctggtgctttgattgctctcggtcgacttaatcgacccagtatgatggtttatggcggtactatccgtcctggctcttgtggcggagaggtgctcgacattgtgtcagctttccagagttatggacgatacctccaagaaggccaaacacctgaggctgaaaagacccgctacaataccattcgaaacgcatgtcctggtcctggagcctgtggaggcatgtacactgctaacacaattgcgtccgcctccgaagccttgggtatgactcttcctgggtcgtcgtctttccctgcggaatatcctgaaaagcatgcggaatgtgacgctgttggcgagactatgcgcaaggttttggaagataaccttctccccagacaaatcatgaccaggcaggctttcgaaaatgcaatggctcttacaatggcgctcggtggatctaccaacgttgttctccatttgatcgccatcgctcggtcggttggtatcaaccttaccattgacgatttccaaacggtctccgatcgagtacctttgctggccgatctcaaacccagtggtaaatacgttatggaagacatcaacaccatcggtggcacgccttccgtcattcactatctgatcaaaaacggaattatgaccggtgacgagatgaccatcaccggtaagactcttggagagaattgtgatcgctgggtggaggagcacggtagcaagtgggaaggacagaagattttgcgacctattaacgatcctcttaagtccactggacacatccgaattctgcgcggtaatcttgcccctggaggtgctgtctctaagatcacaggcaaagaaggcttgcgctttaccggtaaatgccgggctttcgatgatgaggagggcttcgtgaaggccgtcgaaagcggttctatcaaaaagggagagaaaactgttgttgtcttgaggtaccttggccccaagggcggacctggtatgcctgaaatgctcaaacctaccagtttgatcatgggcgctggtctaggatatgatgtcgcttgtctgacagatggacgatttagcggaggttctcatggcttcgttgttggccatgtcgttccggaggcccaggttggaggacccattgctttggttcaagacggcgatgttattcatattgatgccgttgcgaacactttgtctgtggacgtatccgacgaagagatggcccgcagaaaggagaactgggttgcccctcctctcaaggtcactcacggaacattgctcaaatacgcccgagctgttaccgatgcttctcatggatgtgtcacggatgcttaa

SEQ ID NO: 464 - protein, 596 aa, Cryptococcus neoformans
MLSRRIATASPAAHTRAFHASAAKASKEVIMNRYSRTITQPKAQGASQAMLYATEGIVNDEDFNKAMVGVASVWYEGNPCNRHILGLGQRVKKSLMNAGIVGYQFGTVGVSDGISMGTSGMSYSLQSRDLIADSVETAAGGHWLDGMVVLPGCDKNMPGALIALGRLNRPSMMVYGGTIRPGSCGGEVLDIVSAFQSYGRYLQEGQTPEAEKTRYNTIRNACPGPGACGGMYTANTIASASEALGMTLPGSSSFPAEYPEKHAECDAVGETMRKVLEDNLLPRQIMTRQAFENAMALTMALGGSTNVVLHLIAIARSVGINLTIDDFQTVSDRVPLLADLKPSGKYVMEDINTIGGTPSVIHYLIKNGIMTGDEMTITGKTLGENCDRWVEEHGSKWEGQKILRPINDPLKSTGHIRILRGNLAPGGAVSKITGKEGLRFTGKCRAFDDEEGFVKAVESGSIKKGEKTVVVLRYLGPKGGPGMPEMLKPTSLIMGAGLGYDVACLTDGRFSGGSHGFVVGHVVPEAQVGGPIALVQDGDVIHIDAVANTLSVDVSDEEMARRKENWVAPPLKVTHGTLLKYARAVTDASHGCVTDA

SEQ ID NO: 465 - DNA, 1833 bp, Ustilago maydis
atgctgcgatccgccctcagtccctcagcacgttgcgtcctgcgcggcggcctcgcctcccgccgcgctctccacacctcctcagccgctctcaacacagagcgcgctccgccgggcgctctaaacaagtactcgcgtatcatcacccggcccaaggatcagggagcatcgcaagccatgctctacgccaccgacggcatccagtcggacgaggacctcacgcgtgctatggttggtatcggctcgatttggtacgagggcaacccatgcaacgcgcacctgctcgccatctcgcagcgcgtcaaaaagtcggtgcagcaagccggtctcaccggttatcagtttggatctgtcggtgtttcggatggtatctcgatgggtacagacgccatgtcgtactcgctcccgtcgcgtgatctgatcgctgactcggtggaatcggcttgcggtggtcattggcttgatggctgtgtggtgattcccggttgcgacaagaacatgcctggtgtgctgatggctctcggccgtctgaatcgtcccggaatcatgctctacggcggaacgatccgtcccggtggatgtgctagcgtcgagggcacgctcgacattgtctctgctttccagtcgtacggccagtacctcgccaacggaggctctccggctgctgaaaagattcgctatgacaccgtccgcaacgcctgtcccggtcccggtgcgtgcggtggcatgtacaccgccaacaccatggcttcatgcgccgaggctctcggcatgacgctcccaggtagctcgtcgttcccggcagaataccctgaaaagatcgccgaagccgaaaatatgggagccgccatgcgcctcgtcctcgaaaaggacatcaagccgcgcgacatcatgacgcgatccgccttcgaagatgcgatcgctctcaccatggttctcggaggcagcacgaatgcagtcttacatctgattgctgtcgctcactcggtcggcatcgagctcagcattgacgacttccagcgcatcgccgacgtgactccattccttgccgacctcaagccgtcgggcaagtacgtgatggaagatgttcactcgaaactcggcggtatcccgacgattattcagtactgcatcgagaacaagctgatgaagggtgaacacatgaccgtcaccggtcgaacgcttgccgagaacgtcgaccgatggacgcacgagcgcggcaaactgcctgcaggccaagacgtgctccgaccgatcgacaagcctctcaagagcaccggccacattcgaatcctcaagggcaatcttgcgcctggtggcgccgtcgccaagatcactggaaaagagggtctgcgattcacaggtaaagcgcgcgtctttgacaccgaagatgccatggttggcgccgttgaaaagggcgagatcaagaagggtgaaaagacagtgatcgtgttgcgctacaagggtcctaagggtggacctggtatgcccgagatgctcaaacctaccagtttgatcatgggcgctggtcttgggcaggatgtagcctgtttgaccgacggtcggttctccggtggaagtcacggtttcgtcatcggtcacgtcgttcccgaggcacaggtcggaggtccgatcggcctcgtaaaggatggtgatgtgatcagcatcgatgccgagaccaacacgttggagcttgtcggtgtatccgctgccgatctcgagtcccgaagagagtcgtggaagcctctaccgctcaaaccgaaatcgggccacctgctcaagttcgttcgtaacgttgccgatgcttcgcatggttgcatcaccgatatgtga

SEQ ID NO: 466 - protein, 610 aa, Ustilago maydis
MLRSALSPSARCVLRGGLASRRALHTSSAALNTERAPPGALNKYSRIITRPKDQGASQAMLYATDGIQSDEDLTRAMVGIGSIWYEGNPCNAHLLAISQRVKKSVQQAGLTGYQFGSVGVSDGISMGTDAMSYSLPSRDLIADSVESACGGHWLDGCVVIPGCDKNMPGVLMALGRLNRPGIMLYGGTIRPGGCASVEGTLDIVSAFQSYGQYLANGGSPAAEKIRYDTVRNACPGPGACGGMYTANTMASCAEALGMTLPGSSSFPAEYPEKIAEAENMGAAMRLVLEKDIKPRDIMTRSAFEDAIALTMVLGGSTNAVLHLIAVAHSVGIELSIDDFQRIADVTPFLADLKPSGKYVMEDVHSKLGGIPTIIQYCIENKLMKGEHMTVTGRTLAENVDRWTHERGKLPAGQDVLRPIDKPLKSTGHIRILKGNLAPGGAVAKITGKEGLRFTGKARVFDTEDAMVGAVEKGEIKKGEKTVIVLRYKGPKGGPGMPEMLKPTSLIMGAGLGQDVACLTDGRFSGGSHGFVIGHVVPEAQVGGPIGLVKDGDVISIDAETNTLELVGVSAADLESRRESWKPLPLKPKSGHLLKFVRNVADASHGCITDM

SEQ ID NO: 467 - DNA, 1770 bp, Malassezia globosa
atgtcgacgacatgtgcttgcaccacagcaaagaaggatcgcccagcaccaggtgatctgaatcggtactcgcgcttgataacgcaaccaaaagatcagggtgcatcacaggcaatgttgtatgccacgcacggaatccagtcagatgaggatttacgacgtgccatggttggcgtggccagtgtctggtacgaaggcaacccatgcaacgcgcacttgctgggcgttggacagcgaattcgagattctctcgacagggccggcctgacaggctaccaatttggcacagtcggcgtgtctgacggtattagcatgggaaccagtgccatgtcgtactcgcttccgagtcgggatctcattgccgacagcgttgaaagctgcatgggtggccattggcttgatggatgtgttgtggtgccagggtgtgacaagaacatgccgggtgtgctcatggcacttggccgtctgaatcgtccaggcattatggtatatggtggcacgattcgccctggccactgcggatcgatcacaggtacacttgacattgtgagcgcgttccagagttacggacagtacctggcatcaggcggcacgcccgatgccgaaaagatccgctacgacactgtacgtcatgcgtgcccaggaccaggtgcttgcggtggtatgtacacggccaataccatggcatcatgtgcagaggtgctgggtatgacactacccggcagtagctctttccctgccgaatacaacgagaagaaggccgaatgtgacagtattgggccaacgatgcgcatgctgcttgagaagaacattcgcccgcgagatattatgacgcgcagcgcattcgaagatgcaatggtacttacgatggtgctgggtgggtcgacgaatgctgtattgcacctgctcgccatggcccgaagcgtgggcgtagacctatctatcgatgacttccaacgcgtgagtgattcaactccgttccttgccaatctgaagccaagtggccagtacgtcatggaagacgtacacaccgtactgggcggcattccttccgttgtacactacttgattgagaacaaactcatgaaaggtgagcacatgactgtaacgggtcgaacactgcgtgaaaactgtgagcaatgggttgcagagcgcggtcccatgcccaaggaccaagatgttctccgccccatcgacaagccgatcaagcgtacaggccacatccgtgttctttacggcaacctagctcccggtggtgctattgccaagatcacaggcaaggaaggtctcgaatttacagggaaagcacgcgtatttgacacggaagatgacatggtgcatgctgtcgagcaagggacgatcaaaaagggcgagaagactgtggtgatacttcgctacaaaggtcccaagggcggtccagggatgcctgaaatgctcaagccaacgagtttgatcatgggcgcaggtctcggtcacgacgttgcttgcctcacagacggccgctttagcggcggttcgcacggcttcgtgattggacatgtcgttcccgaagcacaagagggtgggccgattgcccttgtgcgggatggcgatgaaatcactatcgatgcggtgaacaactcgatccagatcaacaatgtctcagacgaggagctcgcgcagcgccgcgccgcttggcaaccccggcctcttacagtcaaccagggcggcttgtataaatacacgcgactcgtatcaaacgcaagtcagggctgtgtgacagatgcatga

SEQ ID NO: 468 - protein, 589 aa, Malassezia globosa
MSTTCACTTAKKDRPAPGDLNRYSRLITQPKDQGASQAMLYATHGIQSDEDLRRAMVGVASVWYEGNPCNAHLLGVGQRIRDSLDRAGLTGYQFGTVGVSDGISMGTSAMSYSLPSRDLIADSVESCMGGHWLDGCVVVPGCDKNMPGVLMALGRLNRPGIMVYGGTIRPGHCGSITGTLDIVSAFQSYGQYLASGGTPDAEKIRYDTVRHACPGPGACGGMYTANTMASCAEVLGMTLPGSSSFPAEYNEKKAECDSIGPTMRMLLEKNIRPRDIMTRSAFEDAMVLTMVLGGSTNAVLHLLAMARSVGVDLSIDDFQRVSDSTPFLANLKPSGQYVMEDVHTVLGGIPSVVHYLIENKLMKGEHMTVTGRTLRENCEQWVAERGPMPKDQDVLRPIDKPIKRTGHIRVLYGNLAPGGAIAKITGKEGLEFTGKARVFDTEDDMVHAVEQGTIKKGEKTVVILRYKGPKGGPGMPEMLKPTSLIMGAGLGHDVACLTDGRFSGGSHGFVIGHVVPEAQEGGPIALVRDGDEITIDAVNNSIQINNVSDEELAQRRAAWQPRPLTVNQGGLYKYTRLVSNASQGCVTDA

SEQ ID NO: 469 - DNA, 1824 bp, Aspergillus clavatus
atggatgcctccaaccccgcgctgtccagcacatccgaagcaaaatatatcaacttccccagtcttcccgatgacgcaaaacacgacgacggcacgcttgcgctgaatagatactcgtcctatatcactcgcggccatgacttccctggtgcccgggcaatgctgttcgcggcgggtatcccagatcgcgatgccatgacaaagagcccccaggttggtgttgccagtgtctggtgggagggaaacccgtgcaacatgcacctgttggatttgggcaagacggtcaagaaagccgtcacggagcagggcatgatcggatggcagtataacacgattggggtttcggatgggattacgatgggtagtgatgggatgcgattttctctgcagacgcgcgagatcatcgccgatagtgtcgagacagtgacatgtgcgcagtaccatgatgcctgtattgccatccctggatgtgacaagaacatgcctggcgtggtgatgggcatggcacggcacaatcggccgtcgatcatgatctacggtggcacgattcagatcggctattccaatctcctgcggaagcctatcaacgtgtcgtcttgtttcgaggccgcgggcgcatatgcatacgacactttgcgccaaccggacgacggaggcgataccagcaagaccaaggatgagatcatggatgacctggagagacacgcgtgccccacggcaggcgcctgcggaggcatgttcacggcaaacacgatggccacggcgatcgagtcgatggggctgtctctgcccggatcatcgtcgacacctgcgtcgtcgccatcgaagatgcgggagtgcgtcaaggcggctgaagccatcaaggtctgcatggagaagaacatcaagccccgagatctgttgaccaagcggtcatttgagaacgccctggttatgaccatggcgctgggcggaagcaccaatggtgtcttgcatttcctcgccatggccaggacggccgaggtggatctcaccttggatgatatccagcgagtgagcaataagatccccttcatcgcggatctggctccgagcgggaagtactacatggcggacctgtatgatatcggaggcattccgtctgtgcagaagctgctgatcgcagcgggtctcctcgacggcgatatccccacagtcactggcaagacgttggccgagaacgttgcctccttcccatcgctgcctcaagatcaagtcatcattcgccctctcgataagcccatcaaggcgactgggcacctgcagatcttgcgcggaaacctggcacctggaggagcagtcgccaagatcaccggaaaggagggaaccaaattcacaggcaaagcccgtgtctttaataaggagcatcaattgaacgatgctgtgacccagggcaaaattcctcgtggcgagaacctggtgcttattgtccgttacgaaggccccaagggcggaccgggtatgccggaacagctcaaagccagtgcagcgctcatgggagccaagctcaacaacgtggcgctgatcacagatgggcgatactcaggagccagtcacgggttcatcgtcggccatattgtccccgaagctgcagttggcggaccgattgctgttgtccgtgacggcgatgtgattaccatcgatgcggagaccaacaccatcagcatggatgtttcggacgaggagattcgacagcgtctgaaggaatggaagcccccaacgccccatgtcacacgtggcgtactagccaagtatgccaggctggttggagatgcctctcatggcgcgatgacggatctattctag

SEQ ID NO: 470 - protein, 607 aa, Aspergillus clavatus
MDASNPALSSTSEAKYINFPSLPDDAKHDDGTLALNRYSSYITRGHDFPGARAMLFAAGIPDRDAMTKSPQVGVASVWWEGNPCNMHLLDLGKTVKKAVTEQGMIGWQYNTIGVSDGITMGSDGMRFSLQTREIIADSVETVTCAQYHDACIAIPGCDKNMPGVVMGMARHNRPSIMIYGGTIQIGYSNLLRKPINVSSCFEAAGAYAYDTLRQPDDGGDTSKTKDEIMDDLERHACPTAGACGGMFTANTMATAIESMGLSLPGSSSTPASSPSKMRECVKAAEAIKVCMEKNIKPRDLLTKRSFENALVMTMALGGSTNGVLHFLAMARTAEVDLTLDDIQRVSNKIPFIADLAPSGKYYMADLYDIGGIPSVQKLLIAAGLLDGDIPTVTGKTLAENVASFPSLPQDQVIIRPLDKPIKATGHLQILRGNLAPGGAVAKITGKEGTKFTGKARVFNKEHQLNDAVTQGKIPRGENLVLIVRYEGPKGGPGMPEQLKASAALMGAKLNNVALITDGRYSGASHGFIVGHIVPEAAVGGPIAVVRDGDVITIDAETNTISMDVSDEEIRQRLKEWKPPTPHVTRGVLAKYARLVGDASHGAMTDLF

SEQ ID NO: 471 - DNA, 1827 bp, Neosartorya fischeri
atggactcctctacctccacgtcgtccaacacccagggcgaagccaagtatatcaacttccccagtcttcctgacgacgcaaagcatgaagatggcacccctgcgctgaacagatattcttcttatatcactcggagccatgactttcctggtgctcgggctatgctttttgcagcgggaattccggatcgcgaagcgatggctaagagtccacaggtgggaattgccagtgtctggtgggagggaaatccttgcaatatgcacctgctggacttgggcaagacggtgaagaaggccgttacggatcagggcatgaccggttggcagtataataccattggagtttcagatgccatttcaatgggtagtgagggcatgagattttctctccagtcgcgtgagatcattgcagacagcgtcgagaccgtgacttgtgcgcagtatcatgatgcatgcattgctattcctgggtgcgacaagaatatgcctggagtggtgatgggtatggcgagacacaatcggccttcgcttatgatttacggtggaacaattcaaattggatactcgaacctgctgcgaaagcgggtcaacgtgtcaacttgctttgaagcggctggtgcctatgcctacgatactttgcgtcaaccggacgatgggggtgacaccagtaaaagcaaggacgagattatggatgacattgagagacatgcttgtcccagtgcgggcgcatgtggaggcatgtttactgcaaacacaatggccacggcgattgagtccatgggcctgtccctaccagggtcatcatcaacgcctgcctcgtctccatcgaagatgcgagaatgtgttaaagcggcagaagccatcaagatctgtatggagaagaacattaagcctcgggatcttttgaccaagcgctccttcgagaacgccctcgtcatgacgatggctctgggaggaagtaccaatggtgtcttgcacttccttgccatggctcggacggcggatgtgaacctgaccctagatgatatacaacgggtcagcaacaagatcccattcattgctgacttggcccccagtgggaagtactacatggcagacctgtacgatattggagggatcccgtctgtgcagaagttgctgatcgcagcgggccttcttgacggcgacatccccacggtcaccggcaagaccttggctgagaatgttgcatctttcccatctctacctcaggaccaagtcatcatccgccccctggacaacccaatcaagacgactggccacctgcagattctacgtggaaacctggcgcctggtggagcggtggccaagatcactggcaaggagggcaccaagttcacaggcaaagcacgtgttttcaataaagaatttcagctcaacgatgctctgacccaaggcaagattcctcgaggcgaaaacctggtgctcatcgtccgctacgaaggacccaagggtggaccaggcatgccggagcagctcaaagcgagtgcggcgctgatgggagctaagctcaacaatgtggccctaatcacagatggaagatattcaggggctagtcatggattcatcgtgggtcatatcgtcccagaagctgcggccggaggacccattgccattgttcgcgatgatgatgtgattaccatcgatgcggaaaccaacacaataaacatgcatgtctcagatgaggaaatccagcagcgactgaaagagtggaagcccccagtgcctcatgtcacacgtggtgtactcgccaagtatgcaaggctggttggggacgcctctcatggtgcaatgacggatctgttctag

SEQ ID NO: 472 - protein, 608 aa, Neosartorya fischeri
MDSSTSTSSNTQGEAKYINFPSLPDDAKHEDGTPALNRYSSYITRSHDFPGARAMLFAAGIPDREAMAKSPQVGIASVWWEGNPCNMHLLDLGKTVKKAVTDQGMTGWQYNTIGVSDAISMGSEGMRFSLQSREIIADSVETVTCAQYHDACIAIPGCDKNMPGVVMGMARHNRPSLMIYGGTIQIGYSNLLRKRVNVSTCFEAAGAYAYDTLRQPDDGGDTSKSKDEIMDDIERHACPSAGACGGMFTANTMATAIESMGLSLPGSSSTPASSPSKMRECVKAAEAIKICMEKNIKPRDLLTKRSFENALVMTMALGGSTNGVLHFLAMARTADVNLTLDDIQRVSNKIPFIADLAPSGKYYMADLYDIGGIPSVQKLLIAAGLLDGDIPTVTGKTLAENVASFPSLPQDQVIIRPLDNPIKTTGHLQILRGNLAPGGAVAKITGKEGTKFTGKARVFNKEFQLNDALTQGKIPRGENLVLIVRYEGPKGGPGMPEQLKASAALMGAKLNNVALITDGRYSGASHGFIVGHIVPEAAAGGPIAIVRDDDVITIDAETNTINMHVSDEEIQQRLKEWKPPVPHVTRGVLAKYARLVGDASHGAMTDLF

SEQ ID NO: 473 - DNA, 1827 bp, Aspergillus oryzae
atggatccctccaaccccgccgtctccgcaacctttggggaagcgaaatacatcgaattcccctgtcttccagaggggacgaagcatgaggatggaacacctgcactgaatcgctactctgcaaccatcactagaggccatgacttccctggcgctaaggcaatgctctatgcagcaggtgttcccgaccaaaacgctatggcaaagagtcctcaggtaggagttgcatctgtgtggtgggaaggaaatccgtgtaacatgcacctgctggatatgggcaagacggtaaagaaggccgtcgagggccagggcatgattggttggcaatataacaccattggtgtttcagatgccatcaccatgggcagtgaaggcatgcggttttctctccaaacgcgtgagatcattgcagatagtgtcgagactgtgacttgtgctcagtaccacgatgcctgcattgccatccccggatgcgacaagaacatgcctggagtggtgatgggtatggccaggcataaccggccctccatcatgatctacggcgggactattcagattgggtattccaacctcctacgaaagccaattaacgtttcgagttgcttcgaagccgctggggcttactcatatgatactttgcgtcaaccggacgacggtggagacaccagcaagaccaaggatgagatcatggatgatcttgaaagacatgcctgtcccagcgcgggcgcatgtggaggcatgttcactgcgaacacaatggccacagctatcgagtcgatgggtctgtctttgcctggctcctcttccacccccgctacatctccatcaaaaatgcgagagtgtgtcaaggtggcggaagcgattaaagtttgcatggagaagaatataagaccgcgtgatcttttgactaagcggtcattcgaaaatgccctcgtcatgacgatggctcttggaggaagcaccaacggtgtgctccacttccttgccatggctcggacagctggcgtggaacttactttagatgatattcaaagggtcagtaacaagatcccattcattgctgacctttcccccagtggaaaatactacatggcggacttgtacgatattggcggggtaccgtctgtccaaaagctgttgattgcagggggcctgcttgatggcgatattccaacagttaccggaaagactctggccgagaacgtggcatcattcccatcgttaccggacgatcaggttattattcgtcctttggacaaccctattaaggcgactggccaccttcagatcctccgtggaaacctagcccccggaggcgctgtggccaagatcaccggcaaggagggcactaaatttataggaaaggcacgagtgtttgataaggagtatcaactcaatgatgcactcaaccagggtaaaataccccgagatgagaatttagtgatcatcgtccgttatgagggccccaagggcggaccgggaatgccggaacagctcaaggccagcgcggcattgatgggagccaagcttaccaacgtggcactgatcactgatggaagatactcaggggcaagtcatgggttcatcgtcggccatatcgtacccgaagccgcggtaggaggaccaatcgctgttgtccgcgatggggacgtggtcacaattaatgcggaaaccaacgaaattagcatggatgtctcggatgaagaaatccagcaacggctgagagagtggcaacctcccgcaccgcacgttacacgcggtgtgctggccaagtatgctcggctggttggtgacgcttcccacggcgcaatgacggaccttttctag

SEQ ID NO: 474 - protein, 608 aa, Aspergillus oryzae
MDPSNPAVSATFGEAKYIEFPCLPEGTKHEDGTPALNRYSATITRGHDFPGAKAMLYAAGVPDQNAMAKSPQVGVASVWWEGNPCNMHLLDMGKTVKKAVEGQGMIGWQYNTIGVSDAITMGSEGMRFSLQTREIIADSVETVTCAQYHDACIAIPGCDKNMPGVVMGMARHNRPSIMIYGGTIQIGYSNLLRKPINVSSCFEAAGAYSYDTLRQPDDGGDTSKTKDEIMDDLERHACPSAGACGGMFTANTMATAIESMGLSLPGSSSTPATSPSKMRECVKVAEAIKVCMEKNIRPRDLLTKRSFENALVMTMALGGSTNGVLHFLAMARTAGVELTLDDIQRVSNKIPFIADLSPSGKYYMADLYDIGGVPSVQKLLIAGGLLDGDIPTVTGKTLAENVASFPSLPDDQVIIRPLDNPIKATGHLQILRGNLAPGGAVAKITGKEGTKFIGKARVFDKEYQLNDALNQGKIPRDENLVIIVRYEGPKGGPGMPEQLKASAALMGAKLTNVALITDGRYSGASHGFIVGHIVPEAAVGGPIAVVRDGDVVTINAETNEISMDVSDEEIQQRLREWQPPAPHVTRGVLAKYARLVGDASHGAMTDLF

SEQ ID NO: 475 - DNA, 1827 bp, Aspergillus niger
atggaccccgccaaacctgccgtgtcatccactttgggggaggccaagtaccttgaatttccctgcgtaccagagggcacaaaacacgaagatggtacccccgtcttgaaccgttggtcttctactatcaccaggggccatgagttccctggcgcgaaggctatgctctacgcggcaggcatccccgatcacaatgccatgacgaagagtccccaggttggtgttgcgtctgtgtggtgggaaggcaacccttgcaacatgcacttgttggacctggccaagacggtgaagaaggcgatcacggaccaaggcatgatcgggtggcagtacaatactattggtgtgtcggatgcgattggcatggggagtgaaggtatgcgattttctctccaaacccgtgagatcattgcagacagtgtggagtctgtaacgtgcgctcaataccatgacgcctgcattgccatccccggatgcgacaagaacatgcctggtgtggtgatgggtatggcgagacacaatcggccctcgatcatgctctacggtggtactatcgaggttgggtattcccagcttcttcggaagcgggtaagcgtttcgacgtgcttcgaagcggctggtgcctacacatataacactctccgtcagccggatgacggaggtgataccagcaagaccaaggacgagatcatggatgatctggagaggcatgcctgcccgagcgcgggagcgtgtggtggtatgttcacggccaacaccatggctacggccattgagtccatgggtctctccttgcccggctcgtcttctacgcctgcatcttccccaactaagatgcgtgagtgtgtcaaggcagctgaagccatcaagatttgcatggagaagaacatccgtcctcgggatctgttgaccaagcgggcgttcgagaatgccctggtcatgactatggccctgggaggtagcaccaatggtgtgcttcacttcctggctatggcccgcactgccggcgtggaccttactctggacgacgttcagcgggtcagcaacaagatccctttcattgcggacctgtcccctagtgggaaatactacatggcggacctctacgaagtcggaggcatcccgtcggttcagaagttgttgatcgcagctggtctgctcgacggcgatatccccaccgtgaccggcaaaactctggcccagaacgtcgcatcgcacccatctctgtctgctgaccaggtcatcatccgtcccctggataaccctatcaaggcgacgggccacctccagatcctgcgaggtaaccttgcacccggtggtgcggttgctaagattaccggcaaggaagggctccggttcacgggtaaggcgcgcgtgtttgacaaggagcatcagctcaacgaggccctgaaccagggcaagatccctcacggcgagaacctggttatcgtagttcgttacgagggcccgaagggtggcccgggaatgccggaacaactgaaggccagtgcagcgctcatgggagccaagctcaccaacgtggcactgattacggacgggcggtactctggcgctagtcacggattcattgtggggcatattgtccctgaagctgctgtaggaggacccattgccgttgttcgggacggcgatgtgatcacaattgatgccgaatcgaacgccatcaccatggatgtatcggatgaggaggtgcagcagcgtctgcgggagtggaagcccccggcaccgcatgtcacacgaggtgtgctggccaaatatgcccggttggtgggagatgcctcgaacggagccatgacggatctattttag

SEQ ID NO: 476 - protein, 608 aa, Aspergillus niger
MDPAKPAVSSTLGEAKYLEFPCVPEGTKHEDGTPVLNRWSSTITRGHEFPGAKAMLYAAGIPDHNAMTKSPQVGVASVWWEGNPCNMHLLDLAKTVKKAITDQGMIGWQYNTIGVSDAIGMGSEGMRFSLQTREIIADSVESVTCAQYHDACIAIPGCDKNMPGVVMGMARHNRPSIMLYGGTIEVGYSQLLRKRVSVSTCFEAAGAYTYNTLRQPDDGGDTSKTKDEIMDDLERHACPSAGACGGMFTANTMATAIESMGLSLPGSSSTPASSPTKMRECVKAAEAIKICMEKNIRPRDLLTKRAFENALVMTMALGGSTNGVLHFLAMARTAGVDLTLDDVQRVSNKIPFIADLSPSGKYYMADLYEVGGIPSVQKLLIAAGLLDGDIPTVTGKTLAQNVASHPSLSADQVIIRPLDNPIKATGHLQILRGNLAPGGAVAKITGKEGLRFTGKARVFDKEHQLNEALNQGKIPHGENLVIVVRYEGPKGGPGMPEQLKASAALMGAKLTNVALITDGRYSGASHGFIVGHIVPEAAVGGPIAVVRDGDVITIDAESNAITMDVSDEEVQQRLREWKPPAPHVTRGVLAKYARLVGDASNGAMTDLF

SEQ ID NO: 477 - DNA, 1773 bp, Aspergillus terreus
atggacccctcgactcccgccgtgtcgtccaccatgggcgaggccaaatacatcgaatttcccagtctccccgacgacgcaaaacaccccgatggcacccccgcgctgaaccgctactcaacaaccatcacgagaggccatgactttcccggtgcgaaggccatgctgtatgcggccggcatcccggaccaggaaaccatggccaaagcgccgcacgtcggaatcgcctcggtctggtgggaggggaacccgtgcaacatgcacctgttagatctgggaaagacggtgaagaagtcggtggacgcacagggcatgatcggatggcagtacaacaccattggtgtgtcggacgccattaccatgggcagcgagggaatgcgcttctcgctgcagtcccgcgagatcatcgcggacagcgtcgagacagtcacctgcgcgcagtaccacgacgcgtgcatcgccatccccggctgcgacaagaacatgccgggcgtggtgatgggcatggcgcggcacaatcggccgtcgatcatgatctacggcggcacgatccagatcggctactccaacctgctacgcaagccgatcaacgtgtcgacgtgctttgaggcggcgggcgcctatgcctacgacacgctgcggcagccggacgacggcggcgacacgagcaagaccaaggacgagatcatggacgagctggagcagcacgcgtgcccgagcgcgggcgcgtgcggcggcatgttcacggccaacacgatggcgacggcgatcgagtcgatggggctgtcgctgcccgggtcgtcgtcgacgccggcgtcgtcgccggccaagatgcgcgagtgcgccaaggccgccgacgccatcaagcggtgtctggcgctgaacctccggccgcgcgacctgctcaccaagcgcgcggggcgcccccccgggggtggccccccccctttgagggacatcccagggggtgaggcgaccgcattcccttcattggccaccttttggcccaaggggcaaagttactccatgggcagatctgttcggagattcgggggcgtgcggtccgtgcaggaggttgtttattcgcagccggcctgcttgacggcgccatccccacggtcacgggcaagacccctcgccggagaacgtggcctcggtggccgtccctgcccgccgacccaggtcatcatccgcccgctcgacaaccccatcaagccgacgagccatctgcagattctgcgcggcaacctggcccccggcggcgccgtcgccaagatcaccggcaaggagggcacgcgcttctcgggcaaggccctcgtcttcgacaaggagtaccagctcaacgacgccctgaaccagggccagattccccgcggcgagaacatcgtcatcgtcgtccgctacgagggccccaagggcgggcccggcatgcccgagcaactcaaggcgagcgccgccctgatgggtgcgaagctcaccaatgtggccctgatcaccgatggtcggtactcgggcgcgagccatggcttcatcgtcggccatattgtccccgaggccgcggtgggtggccccattgcggtcgtccgcagcggtgatgtgatcacgattaatgcggaaaccaacgagatcaccatggatgtctcggacgaagagatccagcagcgtctgaaggagtggaagcccccagcacctcatgtcacgcggggcgtgttggccaagtatgcccggttggtgggagatgcttcgcacggtgccatgaccgacctgttttag

SEQ ID NO: 478 - protein, 590 aa, Aspergillus terreus
MDPSTPAVSSTMGEAKYIEFPSLPDDAKHPDGTPALNRYSTTITRGHDFPGAKAMLYAAGIPDQETMAKAPHVGIASVWWEGNPCNMHLLDLGKTVKKSVDAQGMIGWQYNTIGVSDAITMGSEGMRFSLQSREIIADSVETVTCAQYHDACIAIPGCDKNMPGVVMGMARHNRPSIMIYGGTIQIGYSNLLRKPINVSTCFEAAGAYAYDTLRQPDDGGDTSKTKDEIMDELEQHACPSAGACGGMFTANTMATAIESMGLSLPGSSSTPASSPAKMRECAKAADAIKRCLALNLRPRDLLTKRAGRPPGGGPPPLRDIPGGEATAFPSLATFWPKGQSYSMGRSVRRFGGVRSVQEVVYSQPACLTAPSPRSRARPLAGERGLGGRPCPPTQVIIRPLDNPIKPTSHLQILRGNLAPGGAVAKITGKEGTRFSGKALVFDKEYQLNDALNQGQIPRGENIVIVVRYEGPKGGPGMPEQLKASAALMGAKLTNVALITDGRYSGASHGFIVGHIVPEAAVGGPIAVVRSGDVITINAETNEITMDVSDEEIQQRLKEWKPPAPHVTRGVLAKYARLVGDASHGAMTDLF

SEQ ID NO: 479 - DNA, 1827 bp, Coccidioides immitis
atggcttctcaagctcctattgcgcaagatggaccaaacgaggaggcgaaatatatcgacttcccctgtcttcctgatgatgcgatgcgggacggaaaaccggccttgaacaaatattctcagttcattacaaaaggtcatgattacccaggtgcccaggcaatgttatatgctgctggggtacctgatagggatgccatgaaaacgagtcctcatgttggcattgcatcagtatggtgggaaggaaatccctgcaacatgcacttgttggatttaggaaagactgtgaaaaaggctgttatagatcagggcatgctgggatggcaatacaataccattggtgtctctgacgcaatcacaatgggtcatgaaggcatgcgcttttctctgcagtctcgtgagatcattgccgacagcatcgaaactgtgacttgcgcacaataccatgacggttgcattgccatacctggttgtgacaagaacatgcctgggtgtattatggccatgggaagacacaaccgcccctccctgatgatatacggtggtacaattcaaggcggatattcgaaactattgcgacgacccattaacgtttcgacctgctatgaggccgcgggtgcttatgcgtataatactttagtccagccggacgatgggggggacaggagcaaaactaaggatgagatcatggaagacattgaaagacatgcttgtccgagcgctggggcttgcgcaggcatgtatactgcgaacacaatggccacagcaattgagtcgatgggtctgactctgcctggttcatcttctacccccgcaacatcaccagcgaagatgcgagaatgtgtaaaagcggctgatgcaattaaattgtgcatggagaggaacatcagaccgcgcgacttattgacaaaacggtcctttgagaatgccctggtcatgacaatggctctcggtggaagcactaacggcgttgttcatttcattgccatggctagatcggctggtgttcacttaatgctagatgacatccagcgtgttagtgacaaaattccttttatcgcgaacctcgccccaagcggaaaatattacatggcagatctatacgaaattggaggcattccatccgtccagaaattgcttgtcgccgcaggccttttagatggcggtattcccacggtgactggaaagacattggcggagaacattgcatctttcccctccctcccacaagaccaagctatcattcacccacttgacaacccgatcaagtcaaccggccatctccaggtgctcaggggaaaccttgcccctggcggtgctgtcgctaaaattaccggaaaagaaggtactaaatttacgggaaaggctcgcgtatttaacaaagagcacgagttggacgccgctctaagccgtggcgagattccacgcggagataacctcgtcctcgtcgttcgatatgagggaccaaagggtggtcccggaatgccggaacaactcaaagctagtgctgccttgatgggagctaaactcacaaacgtagcgctgattacagatggcagatattcaggtgccagtcatggatttattgttggacacattgtcccagaagctgcagtgggcggtccgattgctgttgtgcaggatggtgatacgatcacaatcaacgcggataccaacgaactcacaatggatgtttctgacgaagaaatcgcacagcgtttgaaggggtggaaaccgccaaaaccacgtgttacccggggggtgctggcgaagtatgctaaattagtcggagatgcatcaaatggtgctatgactgaccagttttag

SEQ ID NO: 480 - protein, 608 aa, Coccidioides immitis
MASQAPIAQDGPNEEAKYIDFPCLPDDAMRDGKPALNKYSQFITKGHDYPGAQAMLYAAGVPDRDAMKTSPHVGIASVWWEGNPCNMHLLDLGKTVKKAVIDQGMLGWQYNTIGVSDAITMGHEGMRFSLQSREIIADSIETVTCAQYHDGCIAIPGCDKNMPGCIMAMGRHNRPSLMIYGGTIQGGYSKLLRRPINVSTCYEAAGAYAYNTLVQPDDGGDRSKTKDEIMEDIERHACPSAGACAGMYTANTMATAIESMGLTLPGSSSTPATSPAKMRECVKAADAIKLCMERNIRPRDLLTKRSFENALVMTMALGGSTNGVVHFIAMARSAGVHLMLDDIQRVSDKIPFIANLAPSGKYYMADLYEIGGIPSVQKLLVAAGLLDGGIPTVTGKTLAENIASFPSLPQDQAIIHPLDNPIKSTGHLQVLRGNLAPGGAVAKITGKEGTKFTGKARVFNKEHELDAALSRGEIPRGDNLVLVVRYEGPKGGPGMPEQLKASAALMGAKLTNVALITDGRYSGASHGFIVGHIVPEAAVGGPIAVVQDGDTITINADTNELTMDVSDEEIAQRLKGWKPPKPRVTRGVLAKYAKLVGDASNGAMTDQF

SEQ ID NO: 481 - DNA, 1788 bp, Paracoccidioides brasiliensis
atgaatcccgaagagaaggtcgatggcttcgaagagccgcgatacatccagttcccttgcctgccggacgatgcgactcgggatggaaagccggtgttgaataaatattctacatttcttacagcgatgttatatggcgcgggggtgccggatcgtgagagcatgaaaaatagcccccaggtcggcattgcgacggtatggtgggaagggaatgcctgtaatatgcaccttttggatctggggaagacggtcaaaaaagccatcacggatcaggggatgctgggctggcaatataacaccatcggtgtctccgatgctatttccatgggtagtgaaggtatgcgatactccctccaatctcgggagatcattgcagacagcatcgagacagtagtaggtgctcaatatcatgatgctgcattgcgattccgttgcgacaagaacatgccaggctgcgtcatgggtatggccagacataacagaccgtctttgatgatatacggtgggacaattcaggtcgggtactccaagttactccgcaggcgaatcaacgtctctacttgctacgaagcagctggcgcgtacgcttacaacaccttaacccagcccgacgacggcggagaccgctcgaggacgaaagatgaaatcatggaagacattgagcgaaatgcctgtcccagcgctggcgcatgcgcgggaatgtacacagcaaacaccctggctaccgcgattgagtcaatgggtttgactctgccaggctcctcgtccaccccagctacggtgcctgccaagatgcgcgagtgcgtaaaagcagcggacgcgatcagaatatgtatggagaagaacattaggccgcgagatctacttacgaaacgctcctttgagaatgcgctggtaataaccatggcgctgggcgggagcacgaacagcatcgttcacctgatagcgatggccagaacggcccgggttgaattaacactcgatgattcccagcgtgtgagcgacaaaatcccgtttattgttgacttggcacccagtgggaaatactacatggcagacctttatgaaattggcgggattccatctgtgcagaagctgttgattgccgcaggcttgatggacggtgacatccccacagtaactggcaaaacgctagcagagaacatccaatccttcccctccctcccacaggaccaggccatcatccacccgctagccaaccccatcaagagcacgggccatatacaaatattgaaaggcaacctcgcccccggcggcgccgtagccaaaatcacaggcaaagaaggcaccaaattcaccggcaaagccctcgttttcaacaaagaacacgagcttgacgaagcgcttaacaagggcctaataccccgcggcgaaaacctagtgctaatagttcgctacgagggtccgaagggtggccccggcatgcccgagcagctgaaggccagcgcagcgctgatgggcgccaaactgacgaatgtcgcgctaattacggacgggaggtattcgggggccagtcatgggtttattgtcgggcatattgtgcctgaggcggcggttggggggcccattgctgttgtgcacaatggggatatgattacgattgatgcggagagaaatgagattagtatggcggtttcggaggaggaggttgcggagaggttgaaggagtggaggccgccgaagccgcatgtgactagggggacgttggccaagtatgcgagacttgttggagacgcgtcgcatggggctatgacggatatgttttga

SEQ ID NO: 482 - protein, 595 aa, Paracoccidioides brasiliensis
MNPEEKVDGFEEPRYIQFPCLPDDATRDGKPVLNKYSTFLTAMLYGAGVPDRESMKNSPQVGIATVWWEGNACNMHLLDLGKTVKKAITDQGMLGWQYNTIGVSDAISMGSEGMRYSLQSREIIADSIETVVGAQYHDAALRFRCDKNMPGCVMGMARHNRPSLMIYGGTIQVGYSKLLRRRINVSTCYEAAGAYAYNTLTQPDDGGDRSRTKDEIMEDIERNACPSAGACAGMYTANTLATAIESMGLTLPGSSSTPATVPAKMRECVKAADAIRICMEKNIRPRDLLTKRSFENALVITMALGGSTNSIVHLIAMARTARVELTLDDSQRVSDKIPFIVDLAPSGKYYMADLYEIGGIPSVQKLLIAAGLMDGDIPTVTGKTLAENIQSFPSLPQDQAIIHPLANPIKSTGHIQILKGNLAPGGAVAKITGKEGTKFTGKALVFNKEHELDEALNKGLIPRGENLVLIVRYEGPKGGPGMPEQLKASAALMGAKLTNVALITDGRYSGASHGFIVGHIVPEAAVGGPIAVVHNGDMITIDAERNEISMAVSEEEVAERLKEWRPPKPHVTRGTLAKYARLVGDASHGAMTDMF

SEQ ID NO: 483 - DNA, 1635 bp, Phaeosphaeria nodorum
atggatccgcgcaaccttgaaaagcagcgagagccagaggagccgcgcttcctcacgttcccgcatctgccagaggatgccatgcgagatggcaagcctgcgttgaacaaatactcgtctactcttactgctggccataactttccgggagctcaggccatgctttatgcggctggtgttccctcgaaggaagccatgaagacacagcctcacgtaggcattgcgagtgtatggtgggaaggcaacccatgcaaaactgcagtgctcgacctgggaaaggagattaagaaaaacgtccaggctgacaatatgctggcatggcagtacaacactgtgggcgtgtcggatggtattacgatgggtggagagggcatgcgcttctctctgcagactcgcgagataatagcagacagtattgagacggtcacgtgcgcgcaacatcacgacgcgtgtattgccattcccggatgcgacaagaatatgcctggtgtcatcatggcatttgcccgtcacaaccgaccatcgataatggtatatggcggctccataatgccaggctattccgagacgctcaagaagcccatcaacatttcaacatgctacgagaaacacggtgcctatatctacaagaatctggagagtgctgaaaaggggaaattttcgccagaggaaatcatggatgacattgagcgcaatgcatgcccgggtgctggcgcatgtggcggcatgtacactgccaacactatgtccacgtccattgaggccaagatgcgcgaatgtgccaaagctgcagctgccatccgcgtctgcatggaaaagaacatcacgccccggaaactactcaccaaggcctccttcgagaatgccctcgtcatgatgatggtcctcggcggctcgaccaacgccgtcctgcacatgctcgccatggccggtacagcaggcgtccccttaacccttgacgacttccagcgcgtgtccaacaaaattcccttcctcgccgacctcgccccctctggccgctacatggctgccgacctctttgacattggcggcatgccctccgtcatgaagctcctcgtcgccgcgggcctccttgacggtagcatccccaccgttaccggcaagaccctcgcagaaaacatcgagccctacccttccttgccgcaagatcaggtcctcatccgccccctctccaaccccatcaaagccaccggccacatcgagatcctacgcggcaacctcgcgcccgccggcgccgtggcgaaaatcacggggaaagagggcttgatattccgcggtagggcgatggtatttgacaaggaacaccagcttgacaaggcgctgaatgaaggtcgtattccgcatggcgagaatatcgtcgttgtcgtgcgctacgagggaccgaagggtggcccgggtatgcccgagcaactcaaagccagcgcggcgattatgggcgcgaaactcaccaacgtcgcgctaattacggatgggcggtatagtggtgccagtcacgggtttattgtcgggcacatgtgtccagaagcggccgtgggtggccccattgctgtggttagggatggggatgttatcactattggtaagtcgtgttgcaaagtcggagagagatggtga

SEQ ID NO: 484 - protein, 544 aa, Phaeosphaeria nodorum
MDPRNLEKQREPEEPRFLTFPHLPEDAMRDGKPALNKYSSTLTAGHNFPGAQAMLYAAGVPSKEAMKTQPHVGIASVWWEGNPCKTAVLDLGKEIKKNVQADNMLAWQYNTVGVSDGITMGGEGMRFSLQTREIIADSIETVTCAQHHDACIAIPGCDKNMPGVIMAFARHNRPSIMVYGGSIMPGYSETLKKPINISTCYEKHGAYIYKNLESAEKGKFSPEEIMDDIERNACPGAGACGGMYTANTMSTSIEAKMRECAKAAAAIRVCMEKNITPRKLLTKASFENALVMMMVLGGSTNAVLHMLAMAGTAGVPLTLDDFQRVSNKIPFLADLAPSGRYMAADLFDIGGMPSVMKLLVAAGLLDGSIPTVTGKTLAENIEPYPSLPQDQVLIRPLSNPIKATGHIEILRGNLAPAGAVAKITGKEGLIFRGRAMVFDKEHQLDKALNEGRIPHGENIVVVVRYEGPKGGPGMPEQLKASAAIMGAKLTNVALITDGRYSGASHGFIVGHMCPEAAVGGPIAVVRDGDVITIGKSCCKVGERW

SEQ ID NO: 485 - DNA, 1803 bp, Gibberella zeae
atggcggaccaagtcactcacgatcccaagcagtcaagcgactacatccccttcccttgccttcctcccggcggagctctcaaccgttggtctacaaagatcacccgcgagcatgactaccccggagctcaggctatgctctacggagctggtgtcaaggaccagcacacaatgaagaacgcgccccaggttggtgttgctaccgtctggtggcaaggaaacccgtgcaatacccatctccttgatcttggccagatcgtcaagaactccatcgagaaggaaggcatgatcggctggcagttcaacaccgttggtgtatctgacgccatcaccatgggcggcgagggcatgcgcttctctcttcaaactcgagaaatcattgctgattctatcgagtccgtaacctgcgcccagcatcatgacgccaacatctccattcccggctgtgacaagaacatgcccggcacagtcatggccgccgctcgtcacaaccgccccttcatcatgatctacggcggtaccatccgcaagggccactccaacctccttgagaagcccatcaacatcagcacctgctacgaggcctcgggtgctttcaactacggtcgtctgcatgccaagacgaaccccggcgagcctggtcgcgagagctccgatgtcatggatgatatcgagaagcacgcttgtcccggcgccggagcttgtggtggcatgtatacagccaacaccatggctaccgctatcgaggccatgggccttactctgcctggttcatcatcgtaccctgccgagtctcctgagaagcgtcgtgagtgtgagcgcgctgcccaggttatccgaactaccatggagaaggaccttcgtcctcgcgatatcatgacccgtgcctctttcgagaacgctcttgtcctgaccatgattctcggtggttcaacaaacggtgttcttcacttcctcgccatggccaacaccgccgatgttcccctgaccattgacgacatccagcgtgccagtgaccgcacccccttcctcgctgatctcgcccccagtggaaagtactacatggaggatctctacaaggtcggcggtacaccctccgtcatcaagatgctcgtcgcccgtggtcttctcgacggtagcatcatgaccattaccggcaagactctcgccgagaacgtcgcggactggcctagtctggaccccggccaggacatcatccgtcctcttgagaaccccatcaaggactctggccacatccgcatcctaaagggtaactttgcccccggcggcgccgtcgctaagatcactggaaaggagggtctgtccttcaccggcaaggcccgtgtcttcaacaccgagaaggagctcaacggcgcactgaaccgaagcgagatcaagcagtccgatggtaacctcgtcgtcatcgtccgatacgagggccccaagggcggtcccggtatgcctgaacagctcaaggcttctgcagccatcatgggtgccggcctctccaacctggcacttgtcaccgacggacgatacagtggtgcttctcacggtttcatcgtgggccacgttgtgcctgaggctatggtcggaggtcccatcgctctggtcaaggatggagacgagatcactatcgatgcgattaacaaccgaatcgatgtcgacatcactgacgaggagatggagaagcgaaggagtgagtggaagcctcctgcgccccgtgttacgaggggtgtgttggccaagtatgcccgcttggtcggtgatgcttcccacggtgctgtaacagatcagtggtag

SEQ ID NO: 486 - protein, 600 aa, Gibberella zeae
MADQVTHDPKQSSDYIPFPCLPPGGALNRWSTKITREHDYPGAQAMLYGAGVKDQHTMKNAPQVGVATVWWQGNPCNTHLLDLGQIVKNSIEKEGMIGWQFNTVGVSDAITMGGEGMRFSLQTREIIADSIESVTCAQHHDANISIPGCDKNMPGTVMAAARHNRPFIMIYGGTIRKGHSNLLEKPINISTCYEASGAFNYGRLHAKTNPGEPGRESSDVMDDIEKHACPGAGACGGMYTANTMATAIEAMGLTLPGSSSYPAESPEKRRECERAAQVIRTTMEKDLRPRDIMTRASFENALVLTMILGGSTNGVLHFLAMANTADVPLTIDDIQRASDRTPFLADLAPSGKYYMEDLYKVGGTPSVIKMLVARGLLDGSIMTITGKTLAENVADWPSLDPGQDIIRPLENPIKDSGHIRILKGNFAPGGAVAKITGKEGLSFTGKARVFNTEKELNGALNRSEIKQSDGNLVVIVRYEGPKGGPGMPEQLKASAAIMGAGLSNLALVTDGRYSGASHGFIVGHVVPEAMVGGPIALVKDGDEITIDAINNRIDVDITDEEMEKRRSEWKPPAPRVTRGVLAKYARLVGDASHGAVTDQW

SEQ ID NO: 487 - DNA, 1923 bp, Neurospora crassa
atggcttccaaccaagataataaggctgtcgctcccgacgccgccgctcccgccggccagtccaccaccaccacgaccaccaacgacaacagcgagcgcaacttgcccaaagagggcgaatacatccaatggcgtactctcccagctggcaaccccgaccagttgaaccgctggtcgcactttttgactcgtgagcatgagtttcctggagctcaggccatgctctacggcgccggtgtcccgaataaggacatgatgaagaaggcgccgcatgtcggcattgcgacggtctggtgggagggcaacccctgcaacacccatttgctggatcttggccaaaaggtcaagaaggccgttgagcgcgagaagatgcttgcgtggcagttcaacaccattggtgtctcggatggtatcaccatgggcggagagggcatgcgctactcgcttcagtctcgcgagatcatcgccgactccatcgagaccgtgacgtgcgctcagcatcatgacgccaacatctccattcccggctgcgacaagaacatgcccggtgtcatcatggccgcggcccgccacaaccgtcccttcgtcatgatctacggcggcaccatgcgcggcggccactcggagctcctcgaccgccccatcaacatcgtcacttgctacgaggcttccggcgcttacacgtatggccgtctcaagcccgcttgccccaacagcaccgccaccccttcggacgtcatggacgacatcgagcagcacgcctgccccggcgccggcgcctgcggcggcatgtacaccgccaacaccatggcgaccgccatcgaagccatgggcctcaccgcaccgggctcctcttctttccctgcctcttcgcccgaaaagttccgcgagtgcgaaaaagccgccgagtacatcaagatctgtatggagaaggacattcgcccgcgcgacctcttgaccaaggcctcgttcgagaacgccctcgtgctcaccatgatcctcggcggttctaccaatggcgttctgcactacctcgccatggccaactcggccgacgtcgacttgactctggacgacatcaaccgcgtctcagccaagacgccctttttggctgacatggccccctccggcaggtactacatggaagacctgtacaaagtcggcggcacccccgcggtcctcaagatgctcatcgccgcaggctatatcgatggcaccatccccactatcaccggcaagtctttggcggaaaacgtatccgactggcctagtctcgaccccgatcaaaaaatcatccgcccccttgacaaccccatcaagtcccaggggcatatccgtgtcttgtacggaaacttctcccccggtggtgcggtcgccaagattacaggcaaggaaggtctctccttcaccggcaaagcccgttgtttcaacaaggaattcgagctcgacgccgccttgaagaactcggaaattaccctcgagcaaggaaaccaggtcctcatcgtgcggtacgaaggacccaaaggcggtccaggtatgccagagcaactgaaggcttcagcggcgatcatgggcgcgggcctgacgaatgtcgcgctggtgacggatggtcggtactctggtgcgtcgcatgggtttattgtgggccatgtggtccccgaggcggcgacgggggggccgattgcgctggtgaaggacggggatttgattacgattgatgcggttaggaaccggattgatgtcgtcaagactgtggaaggcgtcgagggtgaggaagagattgccaaggtgttggaggagagaaagaaggggtggaaggcgccgaagatgaagccgacgaggggggcgttggccaagtatgcgaggttggtgggggatgcgtcgcatggggctgttactgatttgggtggggatgcctattag

SEQ ID NO: 488 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 489 - DNA, 1575 bp, Coprinopsis cinerea
atggataaaccccagatcggtatttcgccggtctggtgggaaggcaatccatgcaatttccacctccttgaccttgcaaagcatgtcaagaaaggctgtcaagaagaagaccagattgggttgatctttaataccatcggtgtcagtgatgccattacgatgggtacagacggaatgcggtacagtctacccagtcgagacctcatcgcggactccatcgaagcagtcgtcatggcccagcactacgacggaaacatcgctattcctggatgcgacaagaacatgcccggctgcttcatggctgctgtccgacacaaccgaccgaccattatcgtctatggagggactatccaacctggtacccggcacgttggtgcctttactgtgggcaagatcaccgatgagcagaggttcgacgttgtgcgacatgcctgtcctggccccggagcctgcggcggaatgtacactgcgaacacgatgagttctgccctcgaggtcctcggcttgtcgctcccgtattcttcaagtatcccagcgatgcatccagagaaggtccaagaatgcttcagggctgccaagtacatgaagaagctgcttgagttggatttgaagcccagggatatcttgacgaagcagtccttcctgaatgccattgtcatcatcaccgttctgggaggctccacgaacgcggttctccacttgttggcaatggcccgagctgctgagattgatctcaccatcgacgacttccaagctgtagcagacaggacaccattcctggccgacctcatgccgtcaggtcgctattacatggaagacatccaccgcattggcggcatccccgccatcgtcaagtatttgttgaaccactccgatctcatcgacggaaaccagatgactgtcactggaaagacgctggctgagaacctagcggatgttcctgagcttgagttccataaccaggacgtcttccgtccactggacaatcctatcaagccgacaggtcatatcacgatcttgagaggtaacctggcgccagaaacagctgttgcgaagctcactggcaaagagggactgagattcgagggtgtcgcgcgttgcttcgatagcctcgagaagttctaccccgctcttgctgcaggggaaatcaaacccggaactgtcctaatcttcagatatcaaggtcccaaaggtgcacccggtatgccggagatgttgggtatgagcgctgcatcgcgtggtccaactggagctatcgcaggcgctggcttggccaactcgactgcgttgatcacggacggccgtttctctggcgccagccgagggtttattattgggcacgtcgtcccagaggcacgagttggcggacccattgcccttgtcaaggacggagacaagatcgtcatcgacgccgagactcgaacaatcaactggctcgtggatgaggaagaacaagcaaagaggaggaaagaatgggaggcgtcggataacggcaagttgaatgtgaagagaggagttttgtaccgatatgccagagatgtcgcgcctgcaagcatgggagcatattgtgattga

SEQ ID NO: 490 - protein, 524 aa, Coprinopsis cinerea
MDKPQIGISPVWWEGNPCNFHLLDLAKHVKKGCQEEDQIGLIFNTIGVSDAITMGTDGMRYSLPSRDLIADSIEAVVMAQHYDGNIAIPGCDKNMPGCFMAAVRHNRPTIIVYGGTIQPGTRHVGAFTVGKITDEQRFDVVRHACPGPGACGGMYTANTMSSALEVLGLSLPYSSSIPAMHPEKVQECFRAAKYMKKLLELDLKPRDILTKQSFLNAIVIITVLGGSTNAVLHLLAMARAAEIDLTIDDFQAVADRTPFLADLMPSGRYYMEDIHRIGGIPAIVKYLLNHSDLIDGNQMTVTGKTLAENLADVPELEFHNQDVFRPLDNPIKPTGHITILRGNLAPETAVAKLTGKEGLRFEGVARCFDSLEKFYPALAAGEIKPGTVLIFRYQGPKGAPGMPEMLGMSAASRGPTGAIAGAGLANSTALITDGRFSGASRGFIIGHVVPEARVGGPIALVKDGDKIVIDAETRTINWLVDEEEQAKRRKEWEASDNGKLNVKRGVLYRYARDVAPASMGAYCD

SEQ ID NO: 491 - DNA, 1767 bp, Laccaria bicolor
atgtcagctccgggagacgtttacattcacgatgtcctcaagaaatcgagcctccccgattcgaagttgaacaggatatcctgtcaattaacgcaaaacaagattcggggtggcgctcaggcgatgctttacgctgtcggtttgagtgaggacgatatgaacaagcctcagattgggatttctccagtgtggtgggaagggaacccatgtaactctcaccttcttgaccttgccaagcacgtaaaggaaggttgtaaagcagaggatcttgttggtcttatcttcaataccattggcgtcagcgacgcgattacgatgggaacagatggaatgagatattctctgccaagtcgagatatcattgcagattcaatcgaagctgctcaacattacgacgccaacatctcaataccagggtgtgacaagaacatgccaggttgcttcatcgccgcagtccgtcataatcgaccaacgatcattgtttacggtggaactattcaaccgggcgtccggcatgtcgattgcccttcgatgggcaaggaaaaaggtggatcagtgaatatctctgacgcatttgaatcttatggggcattcgccgttggaaaaattaacgacgtggagcgatttgatgtcgttcgccacgcatgtcctggcgcaggggcttgtggaggcatgtacactgcgaacaccatgagttcagcccttgaggctcttgggatatctttgccctattcatcgagcacgccagccctgtaccccgagaaggttcaagagtgttttcgagcagcaaagtatttaaaacgtttgcttgaattagatctgaagcccaaggacattttgacccgaaactcgtttttaaatgctatcgtcatcataaccgttctcggtggctccacgaatgcagttttgcacttgctagctatggctcgcgcagctgaggtagaactcacaatcgatgacttccaaatgattgcagacaaaacgcctttcctggccgatttaatgccttcagggaggtattatatggaggatatccacaagatcggaggaatccctgccattctgaaatacctattgaaccacaccgatcttatcgatgggacacagatgacggtgaccgggcgtactttggcagaaaacctcgcagatgtacctgagctcgagttcgataagcaagatgttgttcgaagcttgagcaatcctatcaagaaaacgggccatatcacgatcatgcggggaaatctagctccagagacggccgtagccaaactcacagggaaagaaggtctcaaatttgagggaattgcgagatgctttgatagcttggatggattctatccagcgcttgaggcgggtgagatcaaggcaggcacggtgcttatctttaggtatcaaggaccaaaaggtgcacccggtatgcccgagatgcttggtccaacaggagccattgcaggcgctggacttgctcgttccacagccttaataacagatggtcgcttctcaggagccagtcgaggatttatcataggtcacgtcgtgccggaagcccgtgttggaggacctatcgcactcgttaagaatggggaccgaatcgtcattgattccgagacccgaacgatcaactggctggttgatgagaacgaacaaaaactgcgcaaggcagaatgggatgcctcagagaattcgaaattcaatgtcgggcggggtgtacttttgaggtacgctcgagatgtcgcaccggccaaccttggagcatattgcgattga

SEQ ID NO: 492 - protein, 588 aa, Laccaria bicolor
MSAPGDVYIHDVLKKSSLPDSKLNRISCQLTQNKIRGGAQAMLYAVGLSEDDMNKPQIGISPVWWEGNPCNSHLLDLAKHVKEGCKAEDLVGLIFNTIGVSDAITMGTDGMRYSLPSRDIIADSIEAAQHYDANISIPGCDKNMPGCFIAAVRHNRPTIIVYGGTIQPGVRHVDCPSMGKEKGGSVNISDAFESYGAFAVGKINDVERFDVVRHACPGAGACGGMYTANTMSSALEALGISLPYSSSTPALYPEKVQECFRAAKYLKRLLELDLKPKDILTRNSFLNAIVIITVLGGSTNAVLHLLAMARAAEVELTIDDFQMIADKTPFLADLMPSGRYYMEDIHKIGGIPAILKYLLNHTDLIDGTQMTVTGRTLAENLADVPELEFDKQDVVRSLSNPIKKTGHITIMRGNLAPETAVAKLTGKEGLKFEGIARCFDSLDGFYPALEAGEIKAGTVLIFRYQGPKGAPGMPEMLGPTGAIAGAGLARSTALITDGRFSGASRGFIIGHVVPEARVGGPIALVKNGDRIVIDSETRTINWLVDENEQKLRKAEWDASENSKFNVGRGVLLRYARDVAPANLGAYCD

SEQ ID NO: 493 - DNA, 1794 bp, Ustilago maydis
atggtcaacggagaagtcgagctgcgcacaacttcgcgcaccaatggtgacgctcccgccccgatcctgaacaggatcagtcgatacatcacgcaatcctccgacaagggagctgctcaatccatgcttcacgcgtgcggtctttcggtacaagacctcgacaagccccaggttggcatctcatctgtatggtgggaaggcaacccatgcaatactcacctgctcgaatttggccgcaagatcaagcaaggctgcgaagcggaaggtctggtgggcttgcaaaataacacggtgggcgtttccgatgccatcaccatgggcggccccggaatgcagtattcgcttccttcgagagagctgatcgccgactctatcgagacgatcaccctcgcgcagtatcatgacgctaatgtgtccatccccggttgtgacaagaacatgcctggctgtctcattgcttgtctgcgtcacaaccgcccatcaatcatcgtttatggcggcacgatccaacccggcaagcacggaatggacatacccgctcttggaaggaagaagggcgacccatgcaatgtcgccgacaatttcgaagcgacaggagcttacgccaagggcctcatcacggcagaagagcgtgtcgacctgatccgcaacgcctgtcccggtcctggtgcttgcggaggcatgtacaccgccaacaccttgtctatcgcgatcgaagtcatggggatgggtctcccgttgaccagcagtactcccgctgtctaccctgaaaagatgcaagaatgtctgcgtgttggagcctacatcaagaatctgctagccaaggatatcaagcctcgcgacatcatgaccaagaaggcttttgagaatgctatcgtgatgactcatgttcttggtggctcgactaatgctgttctccatctcatcgctgttgcacgtgctggcgatatcgacattaccatcgacgacttccaaaggctcggcgacaagacacccatgttggccgacgtcaagccatcgggcaagtattacatggaagacattcacaagatcggaggtgttcctcgtgtgctcaagtacattctggagaacacggatctgcttcatggtgacgtgatgacggtgacgggtaaaacgatgcgcgagaatctcgtcgatgttgaaccactggagtttgagacgcaagatatcatccgacctctcagcaaccctatcaaggcaacgggccacctgaccatcatgcgtggatcgctgtgccccggcggagctgtgtccaagctgacgggcaaagaggggctgtactttgacggcagcgctgttgtctttgactctgaagacggcatcaccgaagcaatcgcagaaggccgtgtcaaagaaggcagcgttgtcgtcattcgctatgttggaccaaaaggtggtcctggtatgcccgagatgctcggaccaaccggtgcgatcatgggcgcaggtctcggaaaaacagtagcgctcatcaccgacggtcgtttctctggcgcttcgcacggattttgcacaggacatgttgtgccagaagcagccctgggaggaccgatcgcgctcgtacaagacggagacaggatcactgtcgatgccaacacgcgcgagatcaacttgcacatcagtgacgaagagatggagaagaggaaacagtggtggctcaaagagaaaaagcctactctgacaaagaaacacaagcgcggttggctgtacaagtttgcaagggatgtacaaaacgcttccgagggttgtgttactgatcgcgatctgttttga

SEQ ID NO: 494 - protein, 597 aa, Ustilago maydis
MVNGEVELRTTSRTNGDAPAPILNRISRYITQSSDKGAAQSMLHACGLSVQDLDKPQVGISSVWWEGNPCNTHLLEFGRKIKQGCEAEGLVGLQNNTVGVSDAITMGGPGMQYSLPSRELIADSIETITLAQYHDANVSIPGCDKNMPGCLIACLRHNRPSIIVYGGTIQPGKHGMDIPALGRKKGDPCNVADNFEATGAYAKGLITAEERVDLIRNACPGPGACGGMYTANTLSIAIEVMGMGLPLTSSTPAVYPEKMQECLRVGAYIKNLLAKDIKPRDIMTKKAFENAIVMTHVLGGSTNAVLHLIAVARAGDIDITIDDFQRLGDKTPMLADVKPSGKYYMEDIHKIGGVPRVLKYILENTDLLHGDVMTVTGKTMRENLVDVEPLEFETQDIIRPLSNPIKATGHLTIMRGSLCPGGAVSKLTGKEGLYFDGSAVVFDSEDGITEAIAEGRVKEGSVVVIRYVGPKGGPGMPEMLGPTGAIMGAGLGKTVALITDGRFSGASHGFCTGHVVPEAALGGPIALVQDGDRITVDANTREINLHISDEEMEKRKQWWLKEKKPTLTKKHKRGWLYKFARDVQNASEGCVTDRDLF

SEQ ID NO: 495 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 496 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 497 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 498 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSYGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 499 - DNA, 1836 bp, Agrobacterium tumefaciens
atgccagcctatcgctccagaacgacaacccacggccgcaacatggcgggcgcgcgcggcctttggcgcgccaccggcatgaaggacagcgatttcggcaagccgatcatcgcggtggtcaattccttcacgcagttcgtaccgggccatgtgcatctaaaggatctcggccagctcgttgcccgcgaaatcgaggcggccggcggcgttgccaaggaattcaacacgattgcggtcgatgatggtatcgccatgggccatgacggcatgctctattcgctgccgtcgcgcgagatcatcgctgactcggtcgaatatatggtcaatgcccattgcgccgatgcgatggtctgcatttccaactgcgacaagatcacgcccggcatgctgaatgccgcgatgcgcctcaacattcccgccgttttcgtgtccggtggtccaatggaagcgggcaaggtggttctgcacggcaagaccgttgcgctcgatctggtcgacgcgatggtggctgctgccgacgacaagatttccgatgaggacgtcaagatcatcgagcgctccgcctgcccgacctgcggttcctgttccggcatgttcacggccaattccatgaactgtctgaccgaggcgctcggcctgtcattgcccggcaacggctcgacgcttgccacccactccgatcgcaagcgcctgttcgttgaagccggtcacctgatcgtcgatctggcccgccgttattacgagcaggacgacgaaaccgttctgccgcgcaccatcgccaacaaggcggcgttcgaaaacgccatgtcgctggatattgccatgggcggctccaccaacacggttctgcatattctggcggcagcccacgagggcggcgtcgatttcggtatggaggacatcgaccggctttcccgcaaggttccctgcctttccaaggttgcgcctgcgaagcaggatgtgcacatggaagacgtgcatcgcgccggcggcatcatgcgtattctcggtgagctggagcgtggcggtctcatcaaccgcgatacctataccgtacacgaagcgacgcttggcgatgccatcgaccgctgggacatcacgcgcaccaacagcgaaatggtgcggcagttcttcaaggccgctccgggcggcgtaccgacacaggtggccttcagccagtcctcgcgctgggatgatctggacaccgacagcgacaacggcgtcattcgttcggtcgagaagcctttctccaaggatggcggtctggccgttctttacggcaacatcgcgctcgatggctgcatcgtgaagacggcgggtgttgatgaatccatcctgaaattcaacggatcggcagtcgtttacgaaagccaggacgcggccgtgaagggcattctcggcaacgaggtcaaggcgggcgacgtcgtcgtcatccgctatgaaggaccgaagggcggcccgggcatgcaggaaatgctctatccgaccagctacctcaagtccaagggcctcggtaaagcctgcgcgctcatcaccgatggtcgcttctccggtggcacgtcaggcctttccatcggtcatgcctcgccggaagcggcgcagggcggtgccatcggcctcgtgcgtcagggcgacctgattgagatcgatattccgaaccgcacgatcaatctcaaggtttcggatgcggaactggccgcgcgccgggccgagcaggaagaaaagggctggaagccggaagcaccgcgcaagcgtaatgtcacgacggcgctcaaggcctatgcggcctttgcgtcgagcgcggacaagggtgctgtgcggattctgccggagtaa

SEQ ID NO: 500 - protein, 611 aa, Agrobacterium tumefaciens
MPAYRSRTTTHGRNMAGARGLWRATGMKDSDFGKPIIAVVNSFTQFVPGHVHLKDLGQLVAREIEAAGGVAKEFNTIAVDDGIAMGHDGMLYSLPSREIIADSVEYMVNAHCADAMVCISNCDKITPGMLNAAMRLNIPAVFVSGGPMEAGKVVLHGKTVALDLVDAMVAAADDKISDEDVKIIERSACPTCGSCSGMFTANSMNCLTEALGLSLPGNGSTLATHSDRKRLFVEAGHLIVDLARRYYEQDDETVLPRTIANKAAFENAMSLDIAMGGSTNTVLHILAAAHEGGVDFGMEDIDRLSRKVPCLSKVAPAKQDVHMEDVHRAGGIMRILGELERGGLINRDTYTVHEATLGDAIDRWDITRTNSEMVRQFFKAAPGGVPTQVAFSQSSRWDDLDTDSDNGVIRSVEKPFSKDGGLAVLYGNIALDGCIVKTAGVDESILKFNGSAVVYESQDAAVKGILGNEVKAGDVVVIRYEGPKGGPGMQEMLYPTSYLKSKGLGKACALITDGRFSGGTSGLSIGHASPEAAQGGAIGLVRQGDLIEIDIPNRTINLKVSDAELAARRAEQEEKGWKPEAPRKRNVTTALKAYAAFASSADKGAVRILPE

SEQ ID NO: 501 - DNA, 1902 bp, Burkholderia cenocepacia
gtgcctccacccttttcccgcgatatttcttcagccatcaccatgcccacttaccgttccaaaacctccaccgccggccgcaacatggcaggtgcgcgctcgctgtggcgcgccaccggcatgaaagacgacgatttctcgaaaccgatcatcgcggtcgtcaactcgttcacgcaattcgtgcccgggcacgtgcacctgaaggatctcggccagctcgtcgcgcgcgagatcgaggctgccggcggcgtcgcgaaggaattcaacacgatcgcggtcgacgacggcatcgcgatgggccacgacggcatgctgtactcgctgccgagccgcgacatcatcgccgactcggtcgaatacatggtgaacgcgcactgcgcggacgcgatggtgtgcatctcgaactgcgacaagatcacgccggggatgctgatggccgcgatgcgcctgaacattccggtgatcttcgtgtcgggcggcccgatggaagccggcaagacgcgcctcgcgaacccggtcaccaagaccgtcgaactgaagaagctcgacctcgtcgacgcgatggtgatcgcggccgaccagtcgtattcggacgccgacgtcgccgaagtcgaacgctcggcctgcccgacctgcggctcgtgctcgggcatgttcaccgcgaactcgatgaactgcctgaccgaagcgctcggcctgtcgctgcccggcaacggtacggtggtcgccacgcacgccgatcgcgaacagctgttcaagcgcgccggccgccgcatcgtcgaactgacgcgccagcactacgagcaggacgacgaacgcgtgctgccgcgctcggtcggcttcaaggcgttcgagaacgcgatgacgctcgacatcgcgatgggcggctcgaccaacacgatcctgcacctgctcgcgatcgcgcaggaagccggcatcgacttcacgatgaaggacatcgaccgcctgtcgcgcaccgtgccgcagctgtgcaaggtcgcgccgaacacgaacaagtaccacatcgaggacgtgcaccgcgccggcggcatcatggcgatcctcggcgagctcgagcgcgccggcaagctgcacaccgacgtgccgaccgtccatgcgccgacgctgaaggatgcgctcgaccagtgggacatcgtcctcacgcaggacgaagcggtccgcaggttctacctggccggcccggccggcatcccgacgcaggtcgcgttcagccagaacacgcgctggccgagcctcgacctcgaccgcgccgaaggctgcatccgctcgtacgagcatgcgttctcgaaggaaggcggcctcgcggtgctgacgggcaacatcgcgctcgacggctgcgtggtgaagacggccggcgtcgacgaaagcatcctcgttttcgaaggctcggcgcacgtgaccgaatcgcaggacgaagcggtcgagaacatcctcaacgacaaggtcaaggccggcgacgtggtgatcgtgcgctacgaaggcccgaagggcggcccgggcatgcaggaaatgctctacccgaccagctacatcaagtcgaaagggctcggcaaggcgtgtgcgctgctgacggacggccggttctcgggtggtacgtcggggctgtcgatcggccattgctcgccggaagcggcggcaggcggcgcgatcggcctcgtgcgcgacggcgaccggatccgcatcgacattccgaaccgcacgatcgacgtgctggtgtcggacgaggaactggcgcgccgccgcgaggagcagaacgcgaagggctggaagcctgcgcagccgcgtccgcgcaaggtgtccgcggcgctcaaggcgtacgcgaagctcgtcatgtcggccgacaagggcgccgtgcgcgatctgtcgctgctcgacgactga

SEQ ID NO: 502 - protein, 633 aa, Burkholderia cenocepacia
MPPPFSRDISSAITMPTYRSKTSTAGRNMAGARSLWRATGMKDDDFSKPIIAVVNSFTQFVPGHVHLKDLGQLVAREIEAAGGVAKEFNTIAVDDGIAMGHDGMLYSLPSRDIIADSVEYMVNAHCADAMVCISNCDKITPGMLMAAMRLNIPVIFVSGGPMEAGKTRLANPVTKTVELKKLDLVDAMVIAADQSYSDADVAEVERSACPTCGSCSGMFTANSMNCLTEALGLSLPGNGTVVATHADREQLFKRAGRRIVELTRQHYEQDDERVLPRSVGFKAFENAMTLDIAMGGSTNTILHLLAIAQEAGIDFTMKDIDRLSRTVPQLCKVAPNTNKYHIEDVHRAGGIMAILGELERAGKLHTDVPTVHAPTLKDALDQWDIVLTQDEAVRRFYLAGPAGIPTQVAFSQNTRWPSLDLDRAEGCIRSYEHAFSKEGGLAVLTGNIALDGCVVKTAGVDESILVFEGSAHVTESQDEAVENILNDKVKAGDVVIVRYEGPKGGPGMQEMLYPTSYIKSKGLGKACALLTDGRFSGGTSGLSIGHCSPEAAAGGAIGLVRDGDRIRIDIPNRTIDVLVSDEELARRREEQNAKGWKPAQPRPRKVSAALKAYAKLVMSADKGAVRDLSLLDD

SEQ ID NO: 503 - DNA, 1911 bp, Psychrobacter cryohalolentis
atggattacaattcaaaaacctctaccggcggtcgtaatatggcaggtgctcgtgccctgtggcgcgcaactggcatgactgatggcgactttggcaaacctattattgcaattgccaactcttttacccagtttgtacccggccatgtgcatttaaaagatttgggacaaatggttgcacgcgagattgaaaaagcgggtggcgtggcaaaagaatttaataccattgctgttgatgatggtattgccatgggtcatagcggcatgttgtattcactaccgagtcgagatttgattgctgattctgtcgagtatatggtcaatgcccactgcgccgatgcgctagtatgtatttctaactgcgataaaatcactccgggtatgttgatggcagccatgcgcctcaatatccccgtcgtctttatttcaggtggcccaatggaagcgggtaaaattatcgccagcacggtcgcacacagtcataataatgatggtagtagcgacgtccatagcactgacagtaaaggtaatgccattcgtaagcttgacctcgttgatgcgatgatggacgcggccgatgatagcattagtgatgaagatgtcgctgctattgaggcctcagcgtgcccgacttgtgggtcgtgctctggcatgttcactgccaactcgatgaattgcttgaccgaagcattaggattggcattaccgggtaatggctcgctattggcaacccattcgctacgtcgcgagctattcctagaagcgggtcgtactatcgtgtcactagccaaacgtcgctacgagcaagatgatgattcagtcctaccgcgctctatcgctactaaagccgcgtttgaaaatgccatgactttagacatcgccatgggcggctctaccaatactattttgcatttgcttgctgctgcacatgaagccgaagtcgacttcaaaatgcacgatattgaccgtttaagtcgtggcgtcccttgtttggctaaagttgcccctgcttcacaaaagtatcatatggaagatgtgcatcgtgctggtggtgtctttgcgctattggccgagcttgaccgtgctggtttgctgcataccgatttgccaactatccatagtgccacgatgaaagaagcgattgataaatgggatattatgaatcctgacaatcttgaagcacgtgcacgctatattgcagcccctggtggcgtacggacgactgaggctttctcacaatcaaaagaatggtcaaatctggatgtgaaccgagagtcaggctgtatccgaagtgcccaacatgcttattcaactgatggcggtcttgccgttctatacggaaacattgctgagcgtggctgtgtggtcaaaactgccggcgttgatgacagcatcttggttttcaccggacgtgcacgcatctttgaatcacaagatgatgcagtagcagcggtgcttgatgatcaaatcgtcgcaggcgatgtagttatcatccgttttgagggtccaaaaggcggtcctggtatgcaagagatgctctacccgacgacttatctaaaatctaaaggcctaggcaaagaatgtgcgctgcttacagatggtcgcttctctggtgggacatcaggcttgtctattggtcatgccagcccagaagccgctgaaggcggcgccattggcctagtgcaagaaggcgatactatccatattgatatcccaaaccgtaccatcaatatgcaggtcagtgatgaagagttagctgctcgccgcgaagaaatggaaagtcgtggacgtgatgcttggaaacccgttagccgtgagcgtcatgtctctcctgctttacgtgcctatgctgcaatgaccaccagtgccgatacgggcgctgtacgtgacgtcagccaagttgaacgttag

SEQ ID NO: 504 - protein, 636 aa, Psychrobacter cryohalolentis
MDYNSKTSTGGRNMAGARALWRATGMTDGDFGKPIIAIANSFTQFVPGHVHLKDLGQMVAREIEKAGGVAKEFNTIAVDDGIAMGHSGMLYSLPSRDLIADSVEYMVNAHCADALVCISNCDKITPGMLMAAMRLNIPVVFISGGPMEAGKIIASTVAHSHNNDGSSDVHSTDSKGNAIRKLDLVDAMMDAADDSISDEDVAAIEASACPTCGSCSGMFTANSMNCLTEALGLALPGNGSLLATHSLRRELFLEAGRTIVSLAKRRYEQDDDSVLPRSIATKAAFENAMTLDIAMGGSTNTILHLLAAAHEAEVDFKMHDIDRLSRGVPCLAKVAPASQKYHMEDVHRAGGVFALLAELDRAGLLHTDLPTIHSATMKEAIDKWDIMNPDNLEARARYIAAPGGVRTTEAFSQSKEWSNLDVNRESGCIRSAQHAYSTDGGLAVLYGNIAERGCVVKTAGVDDSILVFTGRARIFESQDDAVAAVLDDQIVAGDVVIIRFEGPKGGPGMQEMLYPTTYLKSKGLGKECALLTDGRFSGGTSGLSIGHASPEAAEGGAIGLVQEGDTIHIDIPNRTINMQVSDEELAARREEMESRGRDAWKPVSRERHVSPALRAYAAMTTSADTGAVRDVSQVER

SEQ ID NO: 505 - DNA, 1851 bp, Psychromonas sp.
atgcccaaattacgttcagcaactagtacagaaggccgaaacatggcaggcgcgcgtgcattgtggcgcgccactggcgtcaaagataatgattttggaaaacctattattgccattgcgaattcatttacccaatttgttcctgggcatgtacatcttaaaaacatgggtgatttagtggcgggtgcgattgctgaggcgggcggtatctctaaagaatttaataccattgcggttgatgacggcattgcgatgggccattcaggtatgctttatagtttaccttcacgtgacctgattgctgatagtgttgaatatatggtaaatgcacattgtgcggatgctttagtgtgtatttcaaattgtgacaagatcacgccggggatgttgatggcggcattacgccttaatattccggttgtttttgtctcaggtggcccgatggaagcgggtaaaaccaagctttcagataaaattattaagttagatttggtcgatgccatggtggcgggcgcagacgacaggatctccgacgctgacagtgcacaaattgagcgcagtgcttgcccaacgtgtggctcttgctctggtatgtttaccgctaactccatgaactgtctaacggaagtcttagggttatcactacccggtaatggcactatgcttgcaacgcacgcagacagacgcgctcttttcttagaagcgggaaagtgcattgtggcattaacgaaacgttattatgacgatgacgatgagtctgttttaccgcgtaatattgccaattttaaagcctttgaaaacgccatgacacttgatattgcgatgggaggctcaagtaatacggtgctgcatttattagctgctgcccaagaagcgcatattgattttaacatggatgatattgatagaatttcacgcttagtgcctcatttgtgcaaagttgccccctctacacctaaatatcatatggaagatgtgcaccgcgcaggtggggtaatgggtattttaggcgaattggacagagccggccttattcataatgacgctaatcatgtggcgggcagtagtttaaaagcggtattagagaaatgggatattgtgcaaactaaagaggcgagtgtgcgtgatttttaccgcgcaggtccgggaggtattccaactcagcaagcttttagtcaggatagtcgctgggatagtgtggatgatgacaggcagaatggctgtattcgtaaacgtgaatttgcgtttagccaagaaggcggacttgccgtgctggcgggtaatattgcgccaaagggctgtattgttaaaacggcgggggtcgatgaagaagagcatcaatttaccggtacggcgcgcgtgtttgagagccaagatgatgcagtgagcgccatcttagcgggaaaagtgattgcgggtgatgtggttgtcattcgttatgaaggccccaaaggtggccccggcatgcaagaaatgttgtatcccaccagttatttaaaatcacgtgggttaggtaaatcatgtgccttaataaccgacggacgattttcgggtggaacctcgggcttatcgattgggcatatttctccagaggctgcagcgggcggtaatattgccttgattgagacgggtgatgttatcaaaattgatattcctgcacgcagtattcaccttgatattagtgatgaagagctcaagttacgccataaaaatatgctagcgcgcggtaaacttgcttggaaacccgtttcgagaaaacgtattgtgccactcgcgcttaaagcttacgctttgctggtgaccagtgcagataaaggggcggttcgtgacgcttcaatgttggaggattaa

SEQ ID NO: 506 - protein, 616 aa, Psychromonas sp.
MPKLRSATSTEGRNMAGARALWRATGVKDNDFGKPIIAIANSFTQFVPGHVHLKNMGDLVAGAIAEAGGISKEFNTIAVDDGIAMGHSGMLYSLPSRDLIADSVEYMVNAHCADALVCISNCDKITPGMLMAALRLNIPVVFVSGGPMEAGKTKLSDKIIKLDLVDAMVAGADDRISDADSAQIERSACPTCGSCSGMFTANSMNCLTEVLGLSLPGNGTMLATHADRRALFLEAGKCIVALTKRYYDDDDESVLPRNIANFKAFENAMTLDIAMGGSSNTVLHLLAAAQEAHIDFNMDDIDRISRLVPHLCKVAPSTPKYHMEDVHRAGGVMGILGELDRAGLIHNDANHVAGSSLKAVLEKWDIVQTKEASVRDFYRAGPGGIPTQQAFSQDSRWDSVDDDRQNGCIRKREFAFSQEGGLAVLAGNIAPKGCIVKTAGVDEEEHQFTGTARVFESQDDAVSAILAGKVIAGDVVVIRYEGPKGGPGMQEMLYPTSYLKSRGLGKSCALITDGRFSGGTSGLSIGHISPEAAAGGNIALIETGDVIKIDIPARSIHLDISDEELKLRHKNMLARGKLAWKPVSRKRIVPLALKAYALLVTSADKGAVRDASMLED

SEQ ID NO: 507 - DNA, 1824 bp, Deinococcus radiodurans
atgccgacttaccgttccagaaccaccaccgagggccgtaatatggccggcgcccgtgccctgtggcgcgccaccggcatgaccgacggcgatttccagaagccgatcatcgcggtggtcaactcgttcacccagttcgtgccggggcacgtgcacctcaaggacctcgggcaactcgtcgcgggtgaaatcgcggcggcgggcggcgtggcgaaggagttcaacaccatcgccgtggacgacggcatcgccatgggccacgacgggatgctctactcactgcccagccgcgaaatcatcgccgacagcgtggagtacatggtcaacgcccactgcgccgacgcgatggtttgcatctccaactgcgacaagattacccccggcatgctgatggccgcgctgcgcctcaatatccccaccgtgttcgtctcgggcgggccgatggaagcgggcaaggtcaagctcggtgacggcgagcacgcgctggacctggtggacgcaatggtgatggccgccgacgacagcgtgagcgaggaagacatcgaactggtggagcgctcggcctgccccacctgcggctcgtgctcgggcatgttcaccgccaactcgatgaactgcctgacggaggcgctgggcctctcgctgccgggcaacggctcggtgctggcgacccactccgaccgccagaacctgttcaagcgcgccgggcacctgatcgtggacctcgccaagcgctactacgagggcgatgacgagagcgtgctgccgcgcagtgtcgccacctacgacgccttcgagaacgccatgaccctcgacatctcgatgggcggctcgaccaatacggtgctgcacctgctggccgccgcgcacgaggccggggtggatttcaccatgcaggacatcgaccagctctcgcggcgggtgccggtgctgtgcaaggtggcgcccgccaagaacgacgtgcacatggaagacgtgcaccgcgctgggggcatcatgggcattctgggcgagcttgaccgcgccgggctgctgaagaccgacgtgagcaccgtacacgcccccagcatgagcgccgccctgaacgagtgggacgtggtccgcaatgagaaccaccacgagttctaccgcgccgcgcccggcggcattcccaccgtcttcgccttctcgcagtcgcgccgttaccgcgaactcgacaccgaccgggaagcaggcgtcattcgcagcgccgagcacgctttctcgcaggacggcgggctggcggtgctgtacggcaacctcgccgaagacggctgcatcgtcaagacggcgggcgtggacgaatccatcctgaagttcagcggcccggcgcgcgttttcgagtcgcaagacgcctcggtggacgccatcctcagcggcgaagtcaaggaaggcgaggtcgtgctgattcgctacgaaggcccacgcggtggccccggcatgcaggaaatgctctacccgacgagctacctcaagtccaaggggctgggcaaagcctgcgcgctggtcaccgacggtcgtttctcgggcggcagcagcggcctgagcatcggccacgtctcgcccgaggcggcggagggcggcaccatcggcctggtcgagacgggcgacctcatcgaaatcgacatcccgaaccgcaccattcacctcgccgtgccggacgctgaactcgccgcccgccgccagaagcgcgaggaagaaggctggcaccccgccgaaccccggccccgcaaaatcaccgctgccctacgcgcctatgcgtctatgacgacgagcgcttcgcggggcgcggtgcggaatatctga

SEQ ID NO: 508 - protein, 607 aa, Deinococcus radiodurans
MPTYRSRTTTEGRNMAGARALWRATGMTDGDFQKPIIAVVNSFTQFVPGHVHLKDLGQLVAGEIAAAGGVAKEFNTIAVDDGIAMGHDGMLYSLPSREIIADSVEYMVNAHCADAMVCISNCDKITPGMLMAALRLNIPTVFVSGGPMEAGKVKLGDGEHALDLVDAMVMAADDSVSEEDIELVERSACPTCGSCSGMFTANSMNCLTEALGLSLPGNGSVLATHSDRQNLFKRAGHLIVDLAKRYYEGDDESVLPRSVATYDAFENAMTLDISMGGSTNTVLHLLAAAHEAGVDFTMQDIDQLSRRVPVLCKVAPAKNDVHMEDVHRAGGIMGILGELDRAGLLKTDVSTVHAPSMSAALNEWDVVRNENHHEFYRAAPGGIPTVFAFSQSRRYRELDTDREAGVIRSAEHAFSQDGGLAVLYGNLAEDGCIVKTAGVDESILKFSGPARVFESQDASVDAILSGEVKEGEVVLIRYEGPRGGPGMQEMLYPTSYLKSKGLGKACALVTDGRFSGGSSGLSIGHVSPEAAEGGTIGLVETGDLIEIDIPNRTIHLAVPDAELAARRQKREEEGWHPAEPRPRKITAALRAYASMTTSASRGAVRNI

SEQ ID NO: 509 - DNA, 1680 bp, Wolinella succinogenes
atgagaagtagcatcattaaagaggggtatcaaaaggcgccacaccgaagcttgctgagggcaacggggctcaaagacgaggattttggtaagccattcattggcgtggccaacagctatattgacatcattccgggtcactttttcttgcaagagtatggccgaatcattaaagaggagattagggccgcgggcggaatcccttttgagtttaacactatcggggtggatgatggaatcgccatggggcatgatggaatgctctatagtttgcccagtcgagagctgattgctgattgtattgagacggtgatgaatgcccataaactggacgccatgatctgtatccctaattgcgacaagattgtccctgggatgcttctgggggcactcagagtgaatgtgcccacggtgtttgtgagtggcggaccgatgaaggcaggtcgcctcaaggatggcaccaaagtggatttggcgagtgcttttgaggcggtgggtaaacgcgcgaggaatcagattagcgatgaagagctccgcgagattgagtgcgccgcctgtccggggggaggaagctgcagtggaatgttcacggcgaactccatgaacacactctgtgaagcgatgggagtggcgcttcccgggaatgggacgattccagccctcaccaaagagcgtgaggagctcatccgaaaagccgcaagaagaatcgtagaaatcgcactagatgagcgctacgccttccgcaatattctcaacaaagaggcgattcacaatgcttttgttgtggatatggcgatggggggaagcaccaataccgtacttcatatgatggccattgccaaagagagagaggcggattttgatttgcgcaaaatcaatgagatcgccaaagaggtgagtcatatcgccaaaatctcccctgcactctacactgtccacatggaagacatcaatagagccgggggcgtgaatgcggtcatgaatgagatcaatcgccgaggcggagtgctcaagacagaggcgctcaccgtgagtggcgagagcatgggtgagaggatcgcgggggcgaagattttagatacgcaaatcattcacacgcttgagaatccctatagcgcggtggggggattgaagattctttatggaaatcttgccgagcagggcgctgtgctcaagaccgctgccatggacgctaagatgagaaaattcactggaaaggcagtctgctttgattctcaagaggaggcgatcgcaggtattgtcgggggcaaggtcaaagagggggatgtggtggtgatccgctacgaaggacccaaggggggaccgggaatgcaggagatgctaagtcccacaagcctcatcatggggatgaatttaggagacaaagtcgcgctcattaccgatggccgtttcagcggcgccacgcgtggcgcttgcatcgggcatgtgagtcccgaagcggccgaagggggaatgatcggactgcttcaagagggcgatcttattcgaatcgatgtcgaagaaggggttttggaggtgttgcttgaggaggcggagatccaaaagcgacgcgcctcctttagtcctaaaactaaaaccgttgcctccaagtggctcaaacgctaccagcttctcgtgagcaatgccgcttcaggcgctattttgaaaacggagctataa

SEQ ID NO: 510 - protein, 559 aa, Wolinella succinogenes
MRSSIIKEGYQKAPHRSLLRATGLKDEDFGKPFIGVANSYIDIIPGHFFLQEYGRIIKEEIRAAGGIPFEFNTIGVDDGIAMGHDGMLYSLPSRELIADCIETVMNAHKLDAMICIPNCDKIVPGMLLGALRVNVPTVFVSGGPMKAGRLKDGTKVDLASAFEAVGKRARNQISDEELREIECAACPGGGSCSGMFTANSMNTLCEAMGVALPGNGTIPALTKEREELIRKAARRIVEIALDERYAFRNILNKEAIHNAFVVDMAMGGSTNTVLHMMAIAKEREADFDLRKINEIAKEVSHIAKISPALYTVHMEDINRAGGVNAVMNEINRRGGVLKTEALTVSGESMGERIAGAKILDTQIIHTLENPYSAVGGLKILYGNLAEQGAVLKTAAMDAKMRKFTGKAVCFDSQEEAIAGIVGGKVKEGDVVVIRYEGPKGGPGMQEMLSPTSLIMGMNLGDKVALITDGRFSGATRGACIGHVSPEAAEGGMIGLLQEGDLIRIDVEEGVLEVLLEEAEIQKRRASFSPKTKTVASKWLKRYQLLVSNAASGAILKTEL

SEQ ID NO: 511 - DNA, 1857 bp, Zymomonas mobilis
atgcctccctatcgttccagaaccacgactcatggtcgtaatatggcgggtgccagaagtttatggcgcgcaaccggcgtcaaaaatgaagattttggtaagccgattatcgctgttgccaacagctttacgcaatttgtccccggtcatgtccatttaaaggatatgggacagcttgttgctgaagaaattgaaaaagctggcggtatcgccaaagaattcaatacgattgcgattgatgatggtatcgcgatgggacatggcgggatgctttattccttgccgtctcgggaattgattgccgattccgtcgaatatatggtcaacgcccattgtgctgatgctttggtctgtatttccaactgcgacaagattacgcctggtatgttgatggcttcgatgcgcctgaatatcccgacagttttcgtctctggtggacctatggaagccggtaaagccgaggtcaaaggcgtcaagcgggcgcttgatctgatcgatgctatggtgattgctgccgatgaccattacagcgatggtgaagtcgaagttatcgagcagacggcttgcgctacctgcggttcctgttccggtatgtttacggccaattcgatgaattgcctgaccgaggccttggggctttctttcccaggtaatggttcgatgcttgcgacccatagcgatcgggaacagcttttccgcaaggctgggcataccattgttgatatggcgcgcagctattatgagcaggatgatgccgctgtattaccgcgttcaattgccacgcttgaggcttttgaaaatgcgatgagtcttgatatcgccatgggtggttccaccaatacggttttgcatctgttggcggtcgcgcaggaaggcaacgtgcctttcactatggcggatattgatcgtctttcccgtcatgtcccttgcttatgcaaggtcgcaccggccaaaaatgatgtccatatggaagatgttcatcgggcagggggcgttatggccattttaggccagcttgatcgtgccggattgatcaataccagcttgcgcaccattcattctccgactttaggcgcagcattggacgcatgggatatcagccgtgacagttgttctgaagaagcgcagttattctatcgcgcggctccggggggtgttccgactcaaaaggctttcagccagtcttctcgctatgaagcgctggatactgaccgcgaaaaaggtgtgattcgttctaaaaatcatgctttttcgacggatggtggtctggccgtcttatttggcaatcttgctcctgaaggcagtattgtcaaaactgccggtgtggatgagtctattctgaaattcaccggtaaagccaaggtttacgaaagtcaggaagccgccgttgccggtattcttggcaatgatgtcgaagctggtgaagtggtgatcgttcgctatgaaggtcccaaaggtggccccggtatgcaggaaatgctgtatccgaccagctatctgaaatcgaaaggtttgggtaaactctgcgctctgattaccgatggtcgtttttctggtggtagctctggtttatccatcggccatgtttctcctgaagcggccgagggcggcttgatcgctttggtcgaaaccggtgatacaattgttatcgatattcctgaacggattatccatctggatgttgatgatgctgttattgccgatcgtcatgcccgcatggaagccaagggggcggcagcatggaaaccgcaaaaccgtaatcgtccgatttcttcggctttgaaagcctatgcagctttgacgacaaacgctgcccgtggggcagttcgagatgtcaatcagctcgaacggcgttaa

SEQ ID NO: 512 - protein, 618 aa, Zymomonas mobilis
MPPYRSRTTTHGRNMAGARSLWRATGVKNEDFGKPIIAVANSFTQFVPGHVHLKDMGQLVAEEIEKAGGIAKEFNTIAIDDGIAMGHGGMLYSLPSRELIADSVEYMVNAHCADALVCISNCDKITPGMLMASMRLNIPTVFVSGGPMEAGKAEVKGVKRALDLIDAMVIAADDHYSDGEVEVIEQTACATCGSCSGMFTANSMNCLTEALGLSFPGNGSMLATHSDREQLFRKAGHTIVDMARSYYEQDDAAVLPRSIATLEAFENAMSLDIAMGGSTNTVLHLLAVAQEGNVPFTMADIDRLSRHVPCLCKVAPAKNDVHMEDVHRAGGVMAILGQLDRAGLINTSLRTIHSPTLGAALDAWDISRDSCSEEAQLFYRAAPGGVPTQKAFSQSSRYEALDTDREKGVIRSKNHAFSTDGGLAVLFGNLAPEGSIVKTAGVDESILKFTGKAKVYESQEAAVAGILGNDVEAGEVVIVRYEGPKGGPGMQEMLYPTSYLKSKGLGKLCALITDGRFSGGSSGLSIGHVSPEAAEGGLIALVETGDTIVIDIPERIIHLDVDDAVIADRHARMEAKGAAAWKPQNRNRPISSALKAYAALTTNAARGAVRDVNQLERR

SEQ ID NO: 513 - DNA, 1659 bp, Clostridium acetobutylicum
gtgaattctgataaggcaatgaaaggagtagaaagagctccccacagatctctttttaaggctttaggttttatagatgaggaaatggatagacctcttataggaatagctaattcttacagcgaacttataccaggtcatatgaatcttgataaaatagttaaggctgtaaaagatggaataagaatggcaggaggtgttcctgtagaatttggaaccattggagtttgtgatggtatttctatgaatcataagggaatgagttattctcttccatcaagacagattatagcagatagtgttgagatcgtggctaaagcacatgctcttgatgggcttgtacttgtgccaaattgcgataaggtagttccaggaatgcttatggcggctggaagagttaacataccttcaatagtaataagtggaggaccaatgctttctggtagaacaaatggaagggtcacagatctaaactctgtattcgaagcagttggagcagtttcagcgggaaaaatgtctttagaagaattagctgagcttgagaatacggcatgccctacttgtgggtcttgttctggaatgtttacagcaaattcaatgaactgtctttctgaggttttaggtcttgcgcttccttacaatggaactataccagctgtattttcagaaagattaagacttgctaaaaaggcaggtatgaaaatagttgaattggttcaaaaggacataagaccaagtgacatacttacagaagctgcatttatgaatgcagtcgcaatggatatggcactagggggttctactaattcacttcttcatttaccagctatagcttatgaatgtgacgtggatattaatttcgataaaataaatgagataagtgaaaagattccgcatgtgtgtaagttaagtcctgcaggatttcatcacatagaggacttgcatatggcaggtggaataccggctgttgttaatggaattataaaaaaaggacttctaaatggagagtgtatgacagttacaggtaaaactttgtatgagaatgtgaaggatgcgaaaatcaaaaacattgatgtaataagaatagataatccttatagtgagacaggtggactttcagtattgagaggaaatttagctccagatggcgctatagttaaaaaggcagcagtagcacccgaaatgatgcagcatactggtccggctagggtatttaatagtgaagaggaagtttctaaggcaatacttggtggaaaaataaatccaggtgatgttgttgtgataaggtatgagggccctaagggtggaccaggaatgaaggaaatgctttcgccaacagcttcacttgcaggaatgggacttgataagagtgtggcgcttataactgatggaagattctcaggtgctacaagaggagcatccattggacatgtatctccagaagcggcagaaggtggtccaatagggttggttgaagagggagacacaattgaaatagatattgaaaagaaaactataaacctacttgttccggaagaaaaattaaaaaacagaaaaccggaaaaggttgaaaaacctgtgaagggatatttaaatacgtataggcagggggtatcatctgcttgtacaggagcagtttttcatagtacaaaggagtga

SEQ ID NO: 514 - protein, 552 aa, Clostridium acetobutylicum
MNSDKAMKGVERAPHRSLFKALGFIDEEMDRPLIGIANSYSELIPGHMNLDKIVKAVKDGIRMAGGVPVEFGTIGVCDGISMNHKGMSYSLPSRQIIADSVEIVAKAHALDGLVLVPNCDKVVPGMLMAAGRVNIPSIVISGGPMLSGRTNGRVTDLNSVFEAVGAVSAGKMSLEELAELENTACPTCGSCSGMFTANSMNCLSEVLGLALPYNGTIPAVFSERLRLAKKAGMKIVELVQKDIRPSDILTEAAFMNAVAMDMALGGSTNSLLHLPAIAYECDVDINFDKINEISEKIPHVCKLSPAGFHHIEDLHMAGGIPAVVNGIIKKGLLNGECMTVTGKTLYENVKDAKIKNIDVIRIDNPYSETGGLSVLRGNLAPDGAIVKKAAVAPEMMQHTGPARVFNSEEEVSKAILGGKINPGDVVVIRYEGPKGGPGMKEMLSPTASLAGMGLDKSVALITDGRFSGATRGASIGHVSPEAAEGGPIGLVEEGDTIEIDIEKKTINLLVPEEKLKNRKPEKVEKPVKGYLNTYRQGVSSACTGAVFHSTKE

SEQ ID NO: 515 - DNA, 1671 bp, Clostridium beijerinckii
atgagaagtgatgtaataacaaaaggatctaaaagtgcacctcaacgttcattgcttagtgccttaggtttaacaaaagaagaaatggaaaggcctcttgtaggtatcgtgagctcacaaaatgatatcgttcctggtcatatgaatttagacaaaatagttgaagctgtaaaaatgggagtttcaatggctggaggtactccaattgtctttcctgcaattgctgtttgtgacggtattgctatggggcatgaaggaatgaaatattcattagttacaagagatttaattgcagattctactgaagctatggcaatggctcatgcctttgatgcattagtaatggttcctaattgtgataaaaatgttcctggccttctaatggctgcagcaagagttaatattcctacaatttttgtaagtggcggaccaatgcttgccggaaaagttgacggatgtaagacaagcttatcaagtatgtttgaagctgttggcgcttacaatgctggaaaaattacagctgaaaaattagatgaatatgaaaacaacgtatgccctacttgtggttcttgttcaggaatgtatactgcaaatagtatgaactgtttaacggaagtacttggtatgggccttcaagggaatggtacaatccctgcagtttattcagaaagaataaaacttgcaaagcatgctggcatgaaaatcatggaattacttgaaaagaacataagaccaagagatattatgacagaagatgcatttatgaatgctatgactatggacatggctcttggctgtagtaccaatagtatgttgcatttacctgcaattgcacacgaagttggctttgatttaaatgttgatatagctaatgaaattagttcaaaaacaccgaatctttgccatcttgctcctgctggacacacttatattgaagatttaaatgatgctggtggaatttatgctgttatgaatgaaataaataagcttggtttattaaaaactaaccttataacatgtacaggaaaaactgttggtgaaaacattgaaggatgcataaataaaaatcctgaagttattagaccagtcaaaaatccatatagtcaaactggtgggattgcagttcttaaaggaaatctagcacctgattcatgtgtcgttaagcgttcagccgttgtaccaaaaatgttaaagcatgaaggtccagctaaagtgtttgattgcgaagaagatgcccttgaagcaataaatacaggaaaaattgttgctggagatgttgttgttatcagatatgaaggacctaaaggaggccctggcatgagagaaatgcttaatccaacttctgcaattgcaggaagaggtcttggaagttccgttgctcttataacagatggacgttttagtggcgctagcagaggtgcttcaatcgggcacgtttctccagaggcggcagtaggtggtaacatagcattagttgaggatggagatatgatccaaattgatattaacgctaacactattaacttcttagttagcgatgaagaattagcaagaagaaaagcaaattggaaaccaagaaaaccaaaaataactacaggttatctagcaagatacgctgctcttgttacatcaggaaatagaggtgctatcctagacatccctaaattttaa

SEQ ID NO: 516 - protein, 556 aa, Clostridium beijerinckii
MRSDVITKGSKSAPQRSLLSALGLTKEEMERPLVGIVSSQNDIVPGHMNLDKIVEAVKMGVSMAGGTPIVFPAIAVCDGIAMGHEGMKYSLVTRDLIADSTEAMAMAHAFDALVMVPNCDKNVPGLLMAAARVNIPTIFVSGGPMLAGKVDGCKTSLSSMFEAVGAYNAGKITAEKLDEYENNVCPTCGSCSGMYTANSMNCLTEVLGMGLQGNGTIPAVYSERIKLAKHAGMKIMELLEKNIRPRDIMTEDAFMNAMTMDMALGCSTNSMLHLPAIAHEVGFDLNVDIANEISSKTPNLCHLAPAGHTYIEDLNDAGGIYAVMNEINKLGLLKTNLITCTGKTVGENIEGCINKNPEVIRPVKNPYSQTGGIAVLKGNLAPDSCVVKRSAVVPKMLKHEGPAKVFDCEEDALEAINTGKIVAGDVVVIRYEGPKGGPGMREMLNPTSAIAGRGLGSSVALITDGRFSGASRGASIGHVSPEAAVGGNIALVEDGDMIQIDINANTINFLVSDEELARRKANWKPRKPKITTGYLARYAALVTSGNRGAILDIPKF

SEQ ID NO: 517 - DNA, 1842 bp, Pseudomonas fluorescens
atgcctgattaccgctcgaaaacatccacccatggccgcaacatggccggcgcccgcgccctgtggcgcgccacggggatgaaagatgacgacttcaagaagccgatcatcgccattgccaactccttcacccagttcgtcccggggcacgtgcacctgaaggacctgggccagctggtggctcgcgagatcgaacgcgccggtggcgtggccaaggaattcaacaccatcgccgtggacgacggcatcgccatgggccatgacggcatgctgtattcgctgccgagccgcgagatcatcgccgactccgtggagtacatggtcaacgcccactgtgccgacgccatcgtgtgcatttccaactgcgacaagatcacccccggcatgctgatggccgccctgcgcctgaacatcccggtgatcttcgtttccggcggcccgatggaagccggcaagaccaagctcgccagccatggcctggacctggtggacgccatggtcatcgccgccgactccagcgcttctgacgagaaggttgccgagtacgagcgcagcgcctgcccgacctgcggttcatgctccggcatgttcaccgccaactccatgaactgcctgaccgaagccctggggctcgccctgccgggcaacggttcgaccctggccacccacagcgatcgcgaagagctgttcctgcgggccgggcgcaccatcgtcgagctgtgccagcgctactacggcgacaacgacgagtcggtcctgccgcgcaacatcgccaacttcaaggcgttcgagaacgccatgaccctggatatcgccatgggcggttccaccaacaccatcctgcacctgctggccgccgcccaggaagccgagatcgacttcgacctgcgggacatcgatcgcctgtcgcgccacgtgccgcagctgtgcaaagtggcgccgaacatccagaagtaccacatggaagacgtgcaccgcgccggcggtatcttcagcatcctcggcgaactggcccgtggcggcctgctgcacaccgacctgcccaccgtgcacagcaagaccatggccgaaggcatcgcccagtgggacatcacccagaccagcgacgaagccgtgcatcacttcttcaaggccggcccggcgggcatcccgacccagacggcgttcagccagtcgacccgttgggacagcctcgacgatgaccgtgaaaacggctgcatccgcagtgtcgagcatgcctactcgaaagaaggcggcctggccgtgctctacggcaacatcgccctggacggctgcgtggtgaagaccgccggtgtcgacgagtcgatccatgtcttcgaaggcaacgccaagatcttcgagagccaggacagcgcggtgcgcggcatcctcgccgacgaggtgaaggaaggcgacatcgtgatcatccgttacgaaggcccgaaaggcggcccgggcatgcaggaaatgctctatccgacctcctacctgaagtccaagggcctgggcaaagcctgcgccctgctcaccgacggccgcttctccggcggcacctcgggcctgtccatcggccacgcctcgcctgaagcggcagccggtggcaccatcggcctggtgcaggacggcgacaaggtactgatcgacattcccaaccgctcgatcaacctgttggtcagcgacgaggaactggcggcccgccgtgtcgagcaggacaagaaaggctggaaaccggtggaagcacgcccgcgcaaggtgaccaccgcgctgaaggcctacgccctgctagccaccagcgccgacaagggtgcggtgcgcaacaaggccatgctcgacggcctgtga

SEQ ID NO: 518 - protein, 613 aa, Pseudomonas fluorescens
MPDYRSKTSTHGRNMAGARALWRATGMKDDDFKKPIIAIANSFTQFVPGHVHLKDLGQLVAREIERAGGVAKEFNTIAVDDGIAMGHDGMLYSLPSREIIADSVEYMVNAHCADAIVCISNCDKITPGMLMAALRLNIPVIFVSGGPMEAGKTKLASHGLDLVDAMVIAADSSASDEKVAEYERSACPTCGSCSGMFTANSMNCLTEALGLALPGNGSTLATHSDREELFLRAGRTIVELCQRYYGDNDESVLPRNIANFKAFENAMTLDIAMGGSTNTILHLLAAAQEAEIDFDLRDIDRLSRHVPQLCKVAPNIQKYHMEDVHRAGGIFSILGELARGGLLHTDLPTVHSKTMAEGIAQWDITQTSDEAVHHFFKAGPAGIPTQTAFSQSTRWDSLDDDRENGCIRSVEHAYSKEGGLAVLYGNIALDGCVVKTAGVDESIHVFEGNAKIFESQDSAVRGILADEVKEGDIVIIRYEGPKGGPGMQEMLYPTSYLKSKGLGKACALLTDGRFSGGTSGLSIGHASPEAAAGGTIGLVQDGDKVLIDIPNRSINLLVSDEELAARRVEQDKKGWKPVEARPRKVTTALKAYALLATSADKGAVRNKAMLDGL

SEQ ID NO: 519 - DNA, 1653 bp, Methanococcus maripaludis
atgataagtgataacgtcaaaaaaggagttataagatctccaaaccgagctcttttaaaagcttgcggatattcagacgaagacatggaaaaaccatttattggtgttgtaaacagcttcacagaagttgttcctggccacattcacttaaaaacattatcagaagcagttaaacatggtgtttatgcaaacggcggaacgccatttgaatttaatacaattggaatttgcgacggtattgcaatgggtcatgaaggtatgaaatactccttaccttcaagagaaatcattgcagatgctgttgaatcaatggcaagagcacacggttttgatggccttgttttaattcctacgtgtgataaaatcgttcctggaatgataatgggtgctttaagattaaatattccatttatcgtagttactgggggaccaatgcttccaggcgaattccaaggtaaaaaatgcgaacttattagtctttttgaaggggttggtgagtatcaggttggaaaaattactgaagaagaattaaaaagtattgaagaatgtgcgtgcccgggtgctggaagctgtgcagggctttacactgcaaacagtatggcatgccttacagaagctctcggactatctcttccaatgtgtgcaacaatacatgcggttgatgctcaaaaggttagaatcgctaaaaaaactggctctaaaattgttgacttggtaaaagaagatgtaaaaccaacagatatattgacaaaggaagcttttgaaaacgctattttagttgaccttgcacttggtggatcgacaaatacaacattacacattcctgcaattgcaaatgaaattgaaaataaattcataactctcgatgactttgatagattgagcaacgaagttccacacattgcatcaatcaaacccggtggagaacactacatgattgacctccataatgcaggaggtattcctgcagtattaaatgttttaaagggaaaaattagagatacaaaaacggttgacggaagaagtactttagaaattgcagaatctgtcaaatacataaattacgacgttataagaaaagtagaagctccagttcacgaaactgccggtttgagagttttaaaaggaaatcttgctccaaacggttgcgttgtaaaaatcggtgcagtaaatccaaaaatgtacaaacacgatggacctgcaaaagtttacaattcagaagatgaagcaatttctgcgatactcggtggaaaaattgtagaaggcgacgttatagtaattagatacgaaggaccatcaggtggcccgggaatgagagaaatgctctccccaacttcagcaatctgtggaatgggtcttgatgacagcgttgcattaattactgacggaagattcagtgggggaagcagaggtccatgtataggccacgtttctccagaagctgctgctggcggagtaattgctgcaattgaaaacggagatatcatcaaaattgacatgattggaaaagaaataaatgttgatttggatgaatcagtaattaaagaaagactttcaaaattggatgaatttgagcctaaaatcaaaaaaggctatttatcaagatattcaaggctcgtttcttcagctgatgaaggagcggttttaaaataa

SEQ ID NO: 520 - protein, 550 aa, Methanococcus maripaludis
MISDNVKKGVIRSPNRALLKACGYSDEDMEKPFIGVVNSFTEVVPGHIHLKTLSEAVKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKCELISLFEGVGEYQVGKITEEELKSIEECACPGAGSCAGLYTANSMACLTEALGLSLPMCATIHAVDAQKVRIAKKTGSKIVDLVKEDVKPTDILTKEAFENAILVDLALGGSTNTTLHIPAIANEIENKFITLDDFDRLSNEVPHIASIKPGGEHYMIDLHNAGGIPAVLNVLKGKIRDTKTVDGRSTLEIAESVKYINYDVIRKVEAPVHETAGLRVLKGNLAPNGCVVKIGAVNPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIGKEINVDLDESVIKERLSKLDEFEPKIKKGYLSRYSRLVSSADEGAVLK

SEQ ID NO: 521 - DNA, 1653 bp, Methanococcus aeolicus
atgataagtgataacttaaagaagggagtttccagagctccaaacagaagtttattaaaggcatgcggatatacggacgaagaaatagaaaaaccattcataggtatagtaaatagctttacagaagtagttcccgggcatattcatttaaatacattggcagaagctgcaaaaaagggagtttatgcaaacggcggaacaccttttgaatttaacactatggccgtatgtgatggtatagctatgggacatgagggaatgagatattcattaccatcaagagagataatagctgatacagtagaaagtatggcgaaagctcatggatttgatggattggtgcttattccgtcctgtgataaaattgttcctggtatgattatgggggctctaagattaaatattccattcatagtaataactggcggacctatgcaacctggggagctccacggtaaaaagtatgaccttataagtgtgtttgaaggagttggagaatataatgttggaaaaattacaaaagaggaattaatggaaattgaaacctgtgcctgtccgggagctggtagctgtgctggattatttacggcaaatagtatggcctgtttaaccgaaacacttggtttatcccttcctatgtgtgctactacacatgcaacagatgccgaaaaggtgagaattgcaaaaagaagcggtatgaaaatagttgatttggtaaaagaagatataaaaccaacagatttattaacaaaggaatcatttgaaaatgcaatattggttgatttggctttgggaggttcttcaaatacaacacttcatattccagctttggcttatgaaatagcaccagagtttataactcttgacgattttgataggttatgcgacgaggtgccacatattgcttcattaaggccggggggagaccactttataagcgatttgcatagggcaggaggtattccagctgttttaaaaatattggagcaaaaaataagggatgctaacactgtaagcggtaaatctattaaagagataataaatgaggtaaaatacattgattataatataattagaccagtggataaaccagtgcatgagaccgcaggattaaggatattaaaaggaaatatagcacctgatggctgtgttgtaaaaattagtgctgtaaatccaaagatgtataaacacgaggggcctgcacgggtatttaattcagaggaggaaaccattgacgcaatacttgggggggacattaaagaaggagatgttgttgtaataagatatgaaggtccagcaggaggtccgggaatgagagaaatgttgtctccaacttctgctatttgtggtatgggattagatgactctgttgcacttattacagatggtagatttagtgggggaagtagaggtccatgtattggacatatctcaccagaggcaatggcaggaggtccaatagccataattgaagaaggagatataattgctattgatatgatggcaaaagaaataaacttaaaaataagcgaagaagagataaaagaaagattagctaattggaaaaaaccagaaataaaagttaaaaaaggatatatatcaagatatgctaaattagtatcttcggcaaatgaaggggcagtattgaaataa

SEQ ID NO: 522 - protein, 550 aa, Methanococcus aeolicus
MISDNLKKGVSRAPNRSLLKACGYTDEEIEKPFIGIVNSFTEVVPGHIHLNTLAEAAKKGVYANGGTPFEFNTMAVCDGIAMGHEGMRYSLPSREIIADTVESMAKAHGFDGLVLIPSCDKIVPGMIMGALRLNIPFIVITGGPMQPGELHGKKYDLISVFEGVGEYNVGKITKEELMEIETCACPGAGSCAGLFTANSMACLTETLGLSLPMCATTHATDAEKVRIAKRSGMKIVDLVKEDIKPTDLLTKESFENAILVDLALGGSSNTTLHIPALAYEIAPEFITLDDFDRLCDEVPHIASLRPGGDHFISDLHRAGGIPAVLKILEQKIRDANTVSGKSIKEIINEVKYIDYNIIRPVDKPVHETAGLRILKGNIAPDGCVVKISAVNPKMYKHEGPARVFNSEEETIDAILGGDIKEGDVVVIRYEGPAGGPGMREMLSPTSAICGMGLDDSVALITDGRFSGGSRGPCIGHISPEAMAGGPIAIIEEGDIIAIDMMAKEINLKISEEEIKERLANWKKPEIKVKKGYISRYAKLVSSANEGAVLK

SEQ ID NO: 523 - DNA, 1842 bp, Vibrio fisheri
atgccaacttatcgttcagccaccaccactcacggacgtaacatggccggagcacgcgctttatggcgtgcaactggcgttaaagaagatgactttggtaaacccatcattgctgttgttaactcatttactcaatttgttccgggtcacgtacatcttaaagacatgggacaacttgttgctggcgaaatagaaaaagccggcggtatcgccaaagagtttaatactatcgccgttgatgatggtatcgctatgggtcacggtggcatgctttattctctgccatcacgcgaactcattgcagactctgttgaatacatggttaatgctcactgtgctgatgctatggtatgtatttctaactgcgacaaaattaccccaggaatgatgatggctgcaatgcgtcttaacattccagtaatttttgtgtcaggcggcccaatggaagcaggaaaaactaagctttcagatcaaataatcaaactggatcttgttgatgcaatgatccaaggtgccgatcctacggtttccgatgctcaaagtgagcagatcgagcgttcagcttgtccaacttgtggatcgtgttcaggaatgttcacggctaactcaatgaactgtttaaccgaagcgctcggtttatctcaaccaggtaatggctcaatgctcgctactcacgccgaccgcgagcagctgtttattaatgcaggtaaacgtattgttgaattaacaaagcgttattatgagcaagatgatgaatcagcacttccaagaaatattgccgaccgtgctgcatttgaaaatgccatggcacttgatatcgcaatgggtggttctagtaataccgttcttcaccttttagcttctgctcaagaaggcgaaattgatttcgatatgggtgacattgatgagatgtctcgtcgagtacctcacttgtgtaaagtcgctccatcaacgcctaaatatcatatggaagatgttcaccgagcaggtggtgtaatggctatccttggtgagttagatagagctgggcttctgaataatcaaacaaaaacggttcttggcttaaccatgcaagagcaacttgcacaatacgatattatgcaaactgaagacgaagagatccttaaattcttccgtgcaggacctgcagggatccgaacaacaaaagcattctcgcaagattgccgttgggatcgccttgatgacgaccgaaaagaagggtgtattcgaaccaaagaaaatgcctttagccaagaaggtggtctcgccgttctatctggcaatatagcggttgatggttgtattgtaaaaaccgccggcgttgatgaagaaaatctaaagttccaaggtccagccattgtttttgaaagccaagactcagcggtagaaggcattttaggtggaaaagttaaagcgggtgaagtcgttgttattcgctacgaaggtccaaagggtggtccaggtatgcaagaaatgctttacccaaccacttacttgaaatcaatgggcttaggcaaagcatgtgcgcttctaactgatggtcgattctctggtggtacatcaggcctatctataggtcacgcatctccagaagctgcaagtggtggcacaataggtttagttaacgatggtgatatcattaccatcgatatcccaagccgctcaattacgcttgatgtaccagaatcagaactgcaagctcgtcgagcgaaacaagatgaactcggttggaaacctgtgaatcgtcaacgtgaagtctcttttgcattaaaagcctatgcaagtatggcaacaagtgcagataaaggtgctgttcgtgataaatctaagttagaagggtaa

SEQ ID NO: 524 - protein, 613 aa, Vibrio fisheri
MPTYRSATTTHGRNMAGARALWRATGVKEDDFGKPIIAVVNSFTQFVPGHVHLKDMGQLVAGEIEKAGGIAKEFNTIAVDDGIAMGHGGMLYSLPSRELIADSVEYMVNAHCADAMVCISNCDKITPGMMMAAMRLNIPVIFVSGGPMEAGKTKLSDQIIKLDLVDAMIQGADPTVSDAQSEQIERSACPTCGSCSGMFTANSMNCLTEALGLSQPGNGSMLATHADREQLFINAGKRIVELTKRYYEQDDESALPRNIADRAAFENAMALDIAMGGSSNTVLHLLASAQEGEIDFDMGDIDEMSRRVPHLCKVAPSTPKYHMEDVHRAGGVMAILGELDRAGLLNNQTKTVLGLTMQEQLAQYDIMQTEDEEILKFFRAGPAGIRTTKAFSQDCRWDRLDDDRKEGCIRTKENAFSQEGGLAVLSGNIAVDGCIVKTAGVDEENLKFQGPAIVFESQDSAVEGILGGKVKAGEVVVIRYEGPKGGPGMQEMLYPTTYLKSMGLGKACALLTDGRFSGGTSGLSIGHASPEAASGGTIGLVNDGDIITIDIPSRSITLDVPESELQARRAKQDELGWKPVNRQREVSFALKAYASMATSADKGAVRDKSKLEG

SEQ ID NO: 525 - DNA, 1860 bp, Shewanella oneidensis
atgccaaagttacgatcagctaccagtacggaaggccgcaatatggcgggtgcccgtgcgctatggcgcgccaccggggtgaaagacaatgattttggtaagccgattattgcgattgccaactcctttactcagtttgttcccggccatgtgcacttaaaagatatgggctcactggtggcgagtgcgattgaagaggcgggcggtatcgccaaagaattcaatactatcgccgtcgacgatggtatcgccatgggccacggtggcatgctctacagtttgccctcgcgggagctgattgccgatagtgtggagtacatggtcaatgcccactgcgccgatgccttagtgtgtatctccaactgcgacaaaatcactcccggcatgttgatggcggcgctgcgtctcaatattcccgtggtatttgtgtcgggtgggccgatggaagcgggtaaaaccaaactgtcggacaaacttatcaagctcgatttagtcgatgccatggtggcggcggccgactcgagtgtgagcgatgaagatagcgccaaaatcgagcgcagtgcttgcccgacgtgtggttcctgttcgggcatgttcaccgccaactctatgaactgtttgaccgaagccctggggttatcgctgccgggcaacggctccatgctggcaacccatagcgatcgccgcgagctgtttttagaggcgggccggcgcgtgatggcgctgaccaagcgttattacgagcaagatgacacctcggcgctgccgcgtaatatcgcctgctttaaagcttttgagaacgccaccgcattagatatcgccatgggcggttcgtctaatactgtgttgcacttgttagcggcggcgcaggaggcggaagtcgcatttactatggacgatatcgaccgtatgtcgcgccttgtgccgcacctttgtaaagtcgccccatcgacgcctaaatatcatatggaagatgtgcaccgcgccggtggcgtgatgggcattttaggcgagcttgaccgcgccggattgctgcataccgatgtgccacacgttgccgccgatgcaggcggaaatctcaagtcggtgcttgccaagtacgatgtcatgcaaacccaagatgacaacgtaaaacaattctttatggcgggacctgcgggcatccccaccactaaagcctttagtcaagactgccgctggccatcgctggatgatgacaggcgagaagggtgtatccgcagccgcgaatttgcctttagccaagaaggcgggctggccgtgctgtcgggcaatttagctgaaaatggctgtattgttaaaacggcgggcgtggatgagtcgaatttgatttttgttggctcggctcgcgtctacgaaagccaagatgatgcggtggcgggcattttaggtggcgaagtagtggcgggcgatgtggtcgtcatccgttacgaagggccaaaaggtggtccgggtatgcaagaaatgttgtaccccaccagttacttaaaatcccgcggcttaggcaaggcctgcgcgctaatcaccgatggacgtttctctggtggaacatccggtttatccatcggccatgtgtcgcccgaggcggcggctggcggcacgattgccttgattgaaaacggcgatcgcattgaaatcgatatcccagcgcgcagtattaagctcgctgtgagcgatgccgagttagcggggcgtcgtgagaccatgttagcgcgtggtccaatggcgtggaagcctgttggtcgcgagcgttttgtatctatggcactaaaagcctacgccatgcttgccaccagtgccgataagggcgcggtgcgcgatcgcagcaagttggaggactga

SEQ ID NO: 526 - protein, 619 aa, Shewanella oneidensis
MPKLRSATSTEGRNMAGARALWRATGVKDNDFGKPIIAIANSFTQFVPGHVHLKDMGSLVASAIEEAGGIAKEFNTIAVDDGIAMGHGGMLYSLPSRELIADSVEYMVNAHCADALVCISNCDKITPGMLMAALRLNIPVVFVSGGPMEAGKTKLSDKLIKLDLVDAMVAAADSSVSDEDSAKIERSACPTCGSCSGMFTANSMNCLTEALGLSLPGNGSMLATHSDRRELFLEAGRRVMALTKRYYEQDDTSALPRNIACFKAFENATALDIAMGGSSNTVLHLLAAAQEAEVAFTMDDIDRMSRLVPHLCKVAPSTPKYHMEDVHRAGGVMGILGELDRAGLLHTDVPHVAADAGGNLKSVLAKYDVMQTQDDNVKQFFMAGPAGIPTTKAFSQDCRWPSLDDDRREGCIRSREFAFSQEGGLAVLSGNLAENGCIVKTAGVDESNLIFVGSARVYESQDDAVAGILGGEVVAGDVVVIRYEGPKGGPGMQEMLYPTSYLKSRGLGKACALITDGRFSGGTSGLSIGHVSPEAAAGGTIALIENGDRIEIDIPARSIKLAVSDAELAGRRETMLARGPMAWKPVGRERFVSMALKAYAMLATSADKGAVRDRSKLED

SEQ ID NO: 527 - DNA, 45 bp, Artificial Sequence
  P2A1 primer
gttattatgccgcttgaaaatgctaaacgtgaagatggtccgctc

SEQ ID NO: 528 - DNA, 45 bp, Artificial Sequence
  P2A1 reverse primer
gagcggaccatcttcacgtttagcattttcaagcggcataataac

SEQ ID NO: 529 - DNA, 44 bp, Artificial Sequence
  G2S2 primer
gaaaatcctaaacgtgaagattctccgctcattattctccatgg

SEQ ID NO: 530 - DNA, 41 bp, Artificial Sequence
  G2S2 reverse primer
tggagaataatgagcggagaatcttcacgtttaggattttc

SEQ ID NO: 531 - DNA, 45 bp, Artificial Sequence
  L2F3 primer
ctaaacgtgaagatggtccgttcattattctccatggtaacttgg

SEQ ID NO: 532 - DNA, 45 bp, Artificial Sequence
  L2F3 reverse primer
ccaagttaccatggagaataatgaacggaccatcttcacgtttag

SEQ ID NO: 533 - DNA, 45 bp, Artificial Sequence
  L2V4 primer
ctaaacgtgaagatggtccggtcattattctccatggtaacttgg

SEQ ID NO: 534 - DNA, 45 bp, Artificial Sequence
  L2V4 reverse primer
ccaagttaccatggagaataatgaccggaccatcttcacgtttag

SEQ ID NO: 535 - DNA, 38 bp, Artificial Sequence
  I2V5 primer
gaagatggtccgctcattgttctccatggtaacttggc

SEQ ID NO: 536 - DNA, 38 bp, Artificial Sequence
  I2V5 reverse primer
gccaagttaccatggagaacaatgagcggaccatcttc

SEQ ID NO: 537 - DNA, 38 bp, Artificial Sequence
  I2M6 primer
gaagatggtccgctcattatgctccatggtaacttggc

SEQ ID NO: 538 - DNA, 76 bp, Artificial Sequence
  I2M6 reverse primer
gaagatggtccgctcattatgctccatggtaacttggcgccaagttaccatggagcataatgagcggaccatcttc

SEQ ID NO: 539 - DNA, 45 bp, Artificial Sequence
  L2I7 primer
gaagatggtccgctcattattatccatggtaacttggctccagac

SEQ ID NO: 540 - DNA, 45 bp, Artificial Sequence
  L2I7 reverse primer
gtctggagccaagttaccatggataataatgagcggaccatcttc

SEQ ID NO: 541 - DNA, 45 bp, Artificial Sequence
  L2M8 primer
gaagatggtccgctcattattatgcatggtaacttggctccagac

SEQ ID NO: 542 - DNA, 45 bp, Artificial Sequence
  L2M8 reverse primer
gtctggagccaagttaccatgcataataatgagcggaccatcttc

SEQ ID NO: 543 - DNA, 1716 bp, Streptococcus mutans DHAD WT
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 544 - protein, 571 aa, Streptococcus mutans; identical to SEQ ID NO: 168

SEQ ID NO: 545 - DNA, 1689 bp, Artificial Sequence
  Streptococcus mutans DHAD enzyme lacking the last 9 amino acids from the C-terminus delta9 variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 546 - protein, 562 aa, Artificial Sequence
  Streptococcus mutans DHAD enzyme lacking the last 9 amino acids from the C-terminus delta9 variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 547 - protein, 11 aa, Artificial Sequence
  11 amino acid motif corresponding to positions 378 to 388 of Streptococcus mutans (S. mutans) DHAD
PKREDGPLIIL

SEQ ID NO: 548 - protein, 11 aa, Artificial Sequence
  11 amino acid motif corresponding to positions 378 to 388 of Streptococcus mutans (S. mutans) DHAD
  MISC_FEATURE (2)..(2): X may either be isoleucine or leucine
  MISC_FEATURE (3)..(3): X may be any natural or non-natural amino acid
  MISC_FEATURE (4)..(4): X may be any natural or non-natural amino acid
  MISC_FEATURE (5)..(5): X may be any natural or non-natural amino acid
  MISC_FEATURE (7)..(7): X may be any natural or non-natural amino acid
  MISC_FEATURE (8)..(8): X may either be isoleucine or leucine
  MISC_FEATURE (9)..(9): X may be any natural or non-natural amino acid
PXXXXGXXXIL

SEQ ID NO: 549 - DNA, 1716 bp, Artificial Sequence
  Streptococcus mutans P2A1 DHAD variant
  misc_feature (1)..(1716): DHAD WT
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatgctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 550 - protein, 571 aa, Artificial Sequence
  Streptococcus mutans P2A1 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENAKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 551 - DNA, 1689 bp, Artificial Sequence
  Streptococcus mutans P2A1 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatgctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 552 - protein, 562 aa, Artificial Sequence
  Streptococcus mutans P2A1 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENAKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 553 - protein, 11 aa, Artificial Sequence
  11 amino acid motif corresponding to positions 378 to 388 of Streptococcus mutans (S. mutans) DHAD
AKREDGPLIIL

SEQ ID NO: 554 - DNA, 1716 bp, Artificial Sequence
  Streptococcus mutans G2S2 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagattctccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 555 - protein, 571 aa, Artificial Sequence
  Streptococcus mutans G2S2 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDSPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 556 - DNA, 1689 bp, Artificial Sequence
  Streptococcus mutans G2S2 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagattctccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 557 - protein, 562 aa, Artificial Sequence
  Streptococcus mutans G2S2 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDSPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 558 - protein, 11 aa, Artificial Sequence
  11 amino acid motif corresponding to positions 378 to 388 of Streptococcus mutans (S. mutans) DHAD
PKREDSPLIIL

SEQ ID NO: 559 - DNA, 1716 bp, Artificial Sequence
  Streptococcus mutans L2F3 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgttcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 560 - protein, 571 aa, Artificial Sequence
  Streptococcus mutans L2F3 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPFIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 561 - DNA, 1689 bp, Artificial Sequence
  Streptococcus mutans L2F3 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgttcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 562 - protein, 562 aa, Artificial Sequence
  Streptococcus mutans L2F3 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPFIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 563 - protein, 11 aa, Artificial Sequence
  11 amino acid motif corresponding to positions 378 to 388 of Streptococcus mutans (S. mutans) DHAD
PKREDGPFIIL

SEQ ID NO: 564 - DNA, 1716 bp, Artificial Sequence
  Streptococcus mutans L2V4 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccggtcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 565 - protein, 571 aa, Artificial Sequence
  Streptococcus mutans L2V4 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPVIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 566 - DNA, 1689 bp, Artificial Sequence
  Streptococcus mutans L2V4 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccggtcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 567 - protein, 562 aa, Artificial Sequence
  Streptococcus mutans L2V4 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPVIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 568 - protein, 11 aa, Artificial Sequence
  11 amino acid motif corresponding to positions 378 to 388 of Streptococcus mutans (S. mutans) DHAD
PKREDGPVIIL

SEQ ID NO: 569 - DNA, 1716 bp, Artificial Sequence
  Streptococcus mutans I2V5 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattgttctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 570 - protein, 571 aa, Artificial Sequence
  Streptococcus mutans I2V5 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIVLHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 571 - DNA, 1689 bp, Artificial Sequence
  Streptococcus mutans I2V5 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattgttctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 572 - protein, 561 aa, Artificial Sequence
  Streptococcus mutans I2V5 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLVLHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 573 - protein, 11 aa, Artificial Sequence
  11 amino acid motif corresponding to positions 378 to 388 of Streptococcus mutans (S. mutans) DHAD
PKREDGPLIVL

SEQ ID NO: 574 - DNA, 1716 bp, Artificial Sequence
  Streptococcus mutans I2M6 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattatgctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 575 - protein, 571 aa, Artificial Sequence
  Streptococcus mutans I2M6 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIMLHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 576 - DNA, 1689 bp, Artificial Sequence
  Streptococcus mutans I2M6 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattatgctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 577 - protein, 562 aa, Artificial Sequence
  Streptococcus mutans I2M6 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIMLHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 578 - protein, 11 aa, Artificial Sequence
  11 amino acid motif corresponding to positions 378 to 388 of Streptococcus mutans (S. mutans) DHAD
PKREDGPLIML

SEQ ID NO: 579 - DNA, 1716 bp, Artificial Sequence
  Streptococcus mutans L2I7 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattatccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 580 - protein, 571 aa, Artificial Sequence
  Streptococcus mutans L2I7 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIIIHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 581 - DNA, 1689 bp, Artificial Sequence
  Streptococcus mutans L2I7 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattatccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 582 - protein, 562 aa, Artificial Sequence
  Streptococcus mutans L2I7 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIIIHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 583 - protein, 11 aa, Artificial Sequence
  11 amino acid motif corresponding to positions 378 to 388 of Streptococcus mutans (S. mutans) DHAD
PKREDGPLIII

SEQ ID NO: 584 - DNA, 1716 bp, Artificial Sequence
  Streptococcus mutans L2M8 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattatgcatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataa

SEQ ID NO: 585 - protein, 571 aa, Artificial Sequence
  Streptococcus mutans L2M8 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIIMHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 586 - DNA, 1689 bp, Artificial Sequence
  Streptococcus mutans L2M8 delta9 DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattatgcatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttga

SEQ ID NO: 587 - protein, 562 aa, Artificial Sequence
  Streptococcus mutans L2M8 delta9 DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIIMHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDF

SEQ ID NO: 588 - protein, 11 aa, Artificial Sequence
  11 amino acid motif corresponding to positions 378 to 388 of Streptococcus mutans (S. mutans) DHAD
PKREDGPLIIM

SEQ ID NO: 589 - protein, 6 aa, Artificial Sequence
  Lumio tag sequence
CCPGCC

SEQ ID NO: 590 - DNA, 12271 bp, Artificial Sequence
  pLH691
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttaattaatcaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 591 - DNA, 12298 bp, Artificial Sequence
  pLH804
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttaattaattattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 592 - DNA, 4519 bp, Artificial
  pLA54
caccttggctaactcgttgtatcatcactggataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatctgaacattagaatacgtaatccgcaatgcggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtac

SEQ ID NO: 593 - DNA, 80 bp, Artificial
  BK505
ttccggtttctttgaaatttttttgattcggtaatctccgagcagaaggagcattgcggattacgtattctaatgttcag

SEQ ID NO: 594 - DNA, 81 bp, Artificial
  BK506
gggtaataactgatataattaaattgaagctctaatttgtgagtttagtacaccttggctaactcgttgtatcatcactgg

SEQ ID NO: 595 - DNA, 38 bp, Artificial
  LA468
gcctcgagttttaatgttacttctcttgcagttaggga

SEQ ID NO: 596 - DNA, 31 bp, Artificial
  LA492
gctaaattcgagtgaaacacaggaagaccag

SEQ ID NO: 597 - DNA, 23 bp, Artificial
  AK109-1
agtcacatcaagatcgtttatgg

SEQ ID NO: 598 - DNA, 23 bp, Artificial
  AK109-2
gcacggaatatgggactacttcg

SEQ ID NO: 599 - DNA, 23 bp, Artificial
  AK109-3
actccacttcaagtaagagtttg

SEQ ID NO: 600 - DNA, 24 bp, Artificial
  oBP452
ttctcgacgtgggcctttttcttg

SEQ ID NO: 601 - DNA, 49 bp, Artificial
  oBP453
tgcagctttaaataatcggtgtcactactttgccttcgtttatcttgcc

SEQ ID NO: 602 - DNA, 49 bp, Artificial
  oBP454
gagcaggcaagataaacgaaggcaaagtagtgacaccgattatttaaag

SEQ ID NO: 603 - DNA, 49 bp, Artificial
  oBP455
tatggaccctgaaaccacagccacattgtaaccaccacgacggttgttg

SEQ ID NO: 604 - DNA, 49 bp, Artificial
  oBP456
tttagcaacaaccgtcgtggtggttacaatgtggctgtggtttcagggt

SEQ ID NO: 605 - DNA, 49 bp, Artificial
  oBP457
ccagaaaccctatacctgtgtggacgtaaggccatgaagctttttcttt

SEQ ID NO: 606 - DNA, 49 bp, Artificial
  oBP458
attggaaagaaaaagcttcatggccttacgtccacacaggtatagggtt

SEQ ID NO: 607 - DNA, 22 bp, Artificial
  oBP459
cataagaacacctttggtggag

SEQ ID NO: 608 - DNA, 22 bp, Artificial
  BP460
aggattatcattcataagtttc

SEQ ID NO: 609 - DNA, 20 bp, Artificial
  LA135
cttggcagcaacaggactag

SEQ ID NO: 610 - DNA, 23 bp, Artificial
  BP461
ttcttggagctgggacatgtttg

SEQ ID NO: 611 - DNA, 22 bp, Artificial
  LA92
gagaagatgcggccagcaaaac

SEQ ID NO: 612 - DNA, 4242 bp, Artificial
  pLA59
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcaatgcggatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 613 - DNA, 80 bp, Artificial
  LA678
caacgttaacaccgttttcggtttgccaggtgacttcaacttgtccttgtgcattgcggattacgtattctaatgttcag

SEQ ID NO: 614 - DNA, 81 bp, Artificial
  LA679
gtggagcatcgaagactggcaacatgatttcaatcattctgatcttagagcaccttggctaactcgttgtatcatcactgg

SEQ ID NO: 615 - DNA, 23 bp, Artificial
  LA337
ctcatttgaatcagcttatggtg

SEQ ID NO: 616 - DNA, 24 bp, Artificial
  LA692
ggaagtcattgacaccatcttggc

SEQ ID NO: 617 - DNA, 24 bp, Artificial
  LA693
agaagctgggacagcagcgttagc

SEQ ID NO: 618 - DNA, 7523 bp, Artificial
  pLA34
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 619 - DNA, 96 bp, Artificial
  LA722
tgccaattatttacctaaacatctataaccttcaaaagtaaaaaaatacacaaacgttgaatcatcaccttggctaactcgttgtatcatcactgg

SEQ ID NO: 620 - DNA, 80 bp, Artificial
  LA733
cataatcaatctcaaagagaacaacacaatacaataacaagaagaacaaagcattgcggattacgtattctaatgttcag

SEQ ID NO: 621 - DNA, 30 bp, Artificial
  LA453
caccgaagaagaatgcaaaaatttcagctc

SEQ ID NO: 622 - DNA, 25 bp, Artificial
  LA694
gctgaagttgttagaactgttgttg

SEQ ID NO: 623 - DNA, 21 bp, Artificial
  LA695
tgttagctggagtagacttgg

SEQ ID NO: 624 - DNA, 22 bp, Artificial
  oBP594
agctgtctcgtgttgtgggttt

SEQ ID NO: 625 - DNA, 49 bp, Artificial
  oBP595
cttaataatagaacaatatcatcctttacgggcatcttatagtgtcgtt

SEQ ID NO: 626 - DNA, 49 bp, Artificial
  oBP596
gcgccaacgacactataagatgcccgtaaaggatgatattgttctatta

SEQ ID NO: 627 - DNA, 49 bp, Artificial
  oBP597
tatggaccctgaaaccacagccacattgcaacgacgacaatgccaaacc

SEQ ID NO: 628 - DNA, 49 bp, Artificial
  oBP598
tccttggtttggcattgtcgtcgttgcaatgtggctgtggtttcagggt

SEQ ID NO: 629 - DNA, 49 bp, Artificial
  oBP599
atcctctcgcggagtccctgttcagtaaaggccatgaagctttttcttt

SEQ ID NO: 630 - DNA, 49 bp, Artificial
  oBP600
attggaaagaaaaagcttcatggcctttactgaacagggactccgcgag

SEQ ID NO: 631 - DNA, 22 bp, Artificial
  oBP601
tcataccacaatcttagaccat

SEQ ID NO: 632 - DNA, 21 bp, Artificial
  oBP602
tgttcaaacccctaaccaacc

SEQ ID NO: 633 - DNA, 22 bp, Artificial
  oBP603
tgttcccacaatctattaccta

SEQ ID NO: 634 - DNA, 31 bp, Artificial
  LA811
aacgaagcatctgtgcttcattttgtagaac

SEQ ID NO: 635 - DNA, 59 bp, Artificial
  LA817
cgatccacttgtatatttggatgaatttttgaggaattctgaaccagtcctaaaacgag

SEQ ID NO: 636 - DNA, 31 bp, Artificial
  LA812
aacaaagatatgctattgaagtgcaagatgg

SEQ ID NO: 637 - DNA, 33 bp, Artificial
  LA818
ctcaaaaattcatccaaatatacaagtggatcg

SEQ ID NO: 638 - DNA, 90 bp, Artificial
  LA512
gtattttggtagattcaattctctttccctttccttttccttcgctccccttccttatcagcattgcggattacgtattctaatgttcag

SEQ ID NO: 639 - DNA, 90 bp, Artificial
  LA513
ttggttgggggaaaaagaggcaacaggaaagatcagagggggagggggggggagagtgtcaccttggctaactcgttgtatcatcactgg

SEQ ID NO: 640 - DNA, 29 bp, Artificial
  LA516
ctcgaaacaataagacgacgatggctctg

SEQ ID NO: 641 - DNA, 30 bp, Artificial
  LA514
cactatctggtgcaaacttggcaccggaag

SEQ ID NO: 642 - DNA, 29 bp, Artificial
  LA515
tgtttgtagccactcgtgaacttctctgc

SEQ ID NO: 643 - DNA, 6903 bp, Artificial
  pLA71
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcgatctgaaatgaataacaatactgacagtagatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctagagctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttaggttttgggacgctcgaaggctttaatttggatccgcattgcggattacgtattctaatgttcagtaccgttcgtataatgtatgctatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 644 - DNA, 96 bp, Artificial
  LA829
ccaaatttacaatatctcctgaattcttggcttggaatatgggcagtacagcttgtgtgatattgcaccttggctaactcgttgtatcatcactgg

SEQ ID NO: 645 - DNA, 90 bp, Artificial
  LA834
atgtcccaaggtagaaaagctgcagaaagattggctaagaagactgtcctcattacaggtgatctgaaatgaataacaatactgacagta

SEQ ID NO: 646 - DNA, 29 bp, Artificial
  N1257
gatgatgctatttggtgcagagggtgatg

SEQ ID NO: 647 - DNA, 29 bp, Artificial
  LA830
cacggcaaacttagaggcacaatagatag

SEQ ID NO: 648 - DNA, 6924 bp, Artificial
  pLA78
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttccaattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaagtttaaacatgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaagtttaaactaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacg

SEQ ID NO: 649 - DNA, 92 bp, Artificial
  LA850
atgactaagctacactttgacactgctgaaccagtcaagatcacacttccaaatggtttgacataaattaccgtcgctcgtgatttgtttgc

SEQ ID NO: 650 - DNA, 94 bp, Artificial
  LA851
ttacaacttaattctgacagcttttacttcagtgtatgcatggtagacttcttcacccatttccaccttggctaactcgttgtatcatcactgg

SEQ ID NO: 651 - DNA, 24 bp, Artificial
  N1262
cacgtaagggcatgatagaattgg

SEQ ID NO: 652 - DNA, 22 bp, Artificial
  LA740
cgataatcctgctgtcattatc

SEQ ID NO: 653 - DNA, 26 bp, Artificial
  N1263
ggatatagcagttgttgtacactagc

SEQ ID NO: 654 - DNA, 6761 bp, Artificial
  pLA65
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttatgaaagcattagtgtataggggcccaggccagaagttggtggaagagagacagaagccagagcttaaggaacctggtgacgctatagtgaaggtaacaaagactacaatttgcggaaccgatctacacattcttaaaggtgacgttgcgacttgtaaacccggtcgtgtattagggcatgaaggagtgggggttattgaatcagtcggatctggggttactgctttccaaccaggcgatagagttttgatatcatgtatatcgagttgcggaaagtgctcattttgtagaagaggaatgttcagtcactgtacgaccgggggttggattctgggcaacgaaattgatggtacccaagcagagtacgtaagagtaccacatgctgacacatccctttatcgtattccggcaggtgcggatgaagaggccttagtcatgttatcagatattctaccaacgggttttgagtgcggagtcctaaacggcaaagtcgcacctggttcttcggtggctatagtaggtgctggtcccgttggtttggccgccttactgacagcacaattctactccccagctgaaatcataatgatcgatcttgatgataacaggctgggattagccaaacaatttggtgccaccagaacagtaaactccacgggtggtaacgccgcagccgaagtgaaagctcttactgaaggcttaggtgttgatactgcgattgaagcagttgggatacctgctacatttgaattgtgtcagaatatcgtagctcccggtggaactatcgctaatgtcggcgttcacggtagcaaagttgatttgcatcttgaaagtttatggtcccataatgtcacgattactacaaggttggttgacacggctaccaccccgatgttactgaaaactgttcaaagtcacaagctagatccatctagattgataacacatagattcagcctggaccagatcttggacgcatatgaaacttttggccaagctgcgtctactcaagcactaaaagtcatcatttcgatggaggcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtg

SEQ ID NO: 655 - DNA, 80 bp, Artificial
  LA855
gcacaatatttcaagctataccaagcatacaatcaactatctcatatacaacctggtaaaacctctagtggagtagtaga

SEQ ID NO: 656 - DNA, 83 bp, Artificial
  LA856
gcttatttagaagtgtcaacaacgtatctaccaacgatttgacccttttccacaccttggctaactcgttgtatcatcactgg

SEQ ID NO: 657 - DNA, 25 bp, Artificial
  LA414
ccagagctgatgaggggtatctcga

SEQ ID NO: 658 - DNA, 25 bp, Artificial
  LA749
caagtcttttgtgccttcccgtcgg

SEQ ID NO: 659 - DNA, 25 bp, Artificial
  LA413
ggacataaaatacacaccgagattc

SEQ ID NO: 660 - DNA, 90 bp, Artificial
  LA860
tctcaattattattttctactcataacctcacgcaaaataacacagtcaaatcaatcaaaatgaaagcattagtgtataggggcccaggc

SEQ ID NO: 661 - DNA, 26 bp, Artificial
  N1093
tttcaagatgcaaatcaactttgcta

SEQ ID NO: 662 - DNA, 20 bp, Artificial
  LA681
ttattgcttagcgttggtag

SEQ ID NO: 663 - DNA, 90 bp, Artificial Sequence
  895
tctcaattattattttctactcataacctcacgcaaaataacacagtcaaatcaatcaaaatgttgacaaaagcaacaaaagaacaaaaa

SEQ ID NO: 664 - DNA, 81 bp, Artificial Sequence; identical to SEQ ID NO: 614
  679

SEQ ID NO: 665 - DNA, 20 bp, Artificial Sequence
  681
ttattgcttagcgttggtag

SEQ ID NO: 666 - DNA, 22 bp, Artificial Sequence
  92
gagaagatgcggccagcaaaac

SEQ ID NO: 667 - DNA, 25 bp, Artificial Sequence
  N245
agggtagcctccccataacataaac

SEQ ID NO: 668 - DNA, 25 bp, Artificial Sequence
  N246
tctccaaatatatacctcttgtgtg

SEQ ID NO: 669 - DNA, 90 bp, Artificial Sequence
  896
ttttatatacagtataaataaaaaacccacgtaatatagcaaaaacatattgccaacaaaaattaccgtcgctcgtgatttgtttgcaaa

SEQ ID NO: 670 - DNA, 90 bp, Artificial Sequence
  897
caaactgtgtaagtttatttatttgcaacaataattcgtttgagtacactactaatggccaccttggctaactcgttgtatcatcactgg

SEQ ID NO: 671 - DNA, 28 bp, Artificial Sequence
  365
ctctatctccgctcaggctaagcaattg

SEQ ID NO: 672 - DNA, 26 bp, Artificial Sequence
  366
cagccgactcaacggcctgtttcacg

SEQ ID NO: 673 - DNA, 28 bp, Artificial Sequence
  N638
aaaagatagtgtagtagtgataaactgg

SEQ ID NO: 674 - DNA, 22 bp, Artificial Sequence
  740
cgataatcctgctgtcattatc

SEQ ID NO: 675 - DNA, 83 bp, Artificial Sequence; identical to SEQ ID NO: 656
  856

SEQ ID NO: 676 - DNA, 79 bp, Artificial Sequence
  857
gcacaatatttcaagctataccaagcatacaatcaactatctcatatacaatgaaagcattagtgtataggggcccagg

SEQ ID NO: 677 - DNA, 80 bp, Artificial Sequence
  BK415
gcacaatatttcaagctataccaagcatacaatcaactatctcatatacaatgaaagcattagtgtataggggcccaggc

SEQ ID NO: 678 - DNA, 26 bp, Artificial Sequence
  N1092
agagttttgatatcatgtatatcgag

SEQ ID NO: 679 - DNA, 25 bp, Artificial Sequence
  413
ggacataaaatacacaccgagattc

SEQ ID NO: 680 - DNA, 92 bp, Artificial Sequence
  906
atgacaggtgaaagaattgaaaaggtgaaaataaatgacgaatttgcaaaatcacatttcacctggtaaaacctctagtggagtagtagatg

SEQ ID NO: 681 - DNA, 87 bp, Artificial Sequence
  907
aaaaagattcaatgccgtctcctttcgaaacttaataatagaacaatatcatccttcaccttggctaactcgttgtatcatcactgg

SEQ ID NO: 682 - DNA, 70 bp, Artificial Sequence
  667
tctcctttcgaaacttaataatagaacaatatcatccttttgtaaaacgacggccagtgaattcaccttg

SEQ ID NO: 683 - DNA, 25 bp, Artificial Sequence
  749
caagtcttttgtgccttcccgtcgg

SEQ ID NO: 684 - DNA, 1485 bp, Vibrio cholerae
atggctaactattttaacactctgaatctgcgcgaacagctggatcagctgggtcgttgtcgcttcatggcgcgcgaggaattcgcaactgaagcggactacctgaagggtaagaaagtggtcatcgtaggctgtggcgcgcagggcctgaaccagggtctgaatatgcgtgatagcggcctggacgtgtcttacgcactgcgtcaagcggccatcgatgaacagcgtcagtctttcaaaaatgctaagaacaacggtttcaatgtaggttcttacgaacagctgattccgacggcggacctggttatcaatctgaccccggataaacagcacaccagcgtggttaacgcggttatgccgctgatgaaacagggcgctgctctgggctatagccatggttttaacatcgtggaagagggcatgcagattcgtaaagacatcacggtagtaatggtggcgccgaaatgcccaggtactgaggttcgtgaggaatacaagcgtggttttggcgttcctaccctgattgcagtgcacccggaaaacgatccgcagggcgaaggttgggaaatcgctaaggcatgggctgcagccactggtggccaccgcgctggttgcctggcctctagcttcgtcgcagaagtaaaaagcgacctgatgggcgaacagaccatcctgtgtggtatgctgcaggccggtagcatcgtttgctacgaaaagatggttgctgatggtatcgacccgggctacgcgggcaaactgctgcagtttggttgggaaactattaccgaggctctgaaattcggtggcatcacccacatgatggaccgtctgagcaacccggcaaagatcaaagcattcgaactgtctgaagagctgaaagacctgatgcgtccgctgtacaacaagcacatggacgacattatttccggccacttttcttctaccatgatggcggactgggccaacgacgacaaggatctgttcggctggcgtgcggagaccgctgaaaccgcatttgaaaactatccgaccactgacgttaagatcgcggagcaggaatactttgacaacggtatcctgatgattgcaatggttcgcgcgggcgttgaactggcgtttgaagcgatgaccgcttctggtatcatcgatgaatctgcatactatgagtccctgcacgagctgccgctgatcgctaacacggtggcccgcaaacgtctgtatgaaatgaatgtcgtaatctctgacacggctgaatatggtaattatctgttcgccaatgtggcagttcctctgctgcgtgagaaattcatgccgaaagtgggtaccgatgttattggtaaaggtctgggtgtcgtttctaaccaggtagataacgcgactctgatcgaagtgaactccatcatccgtaaccacccggtggaatacattggtgaagaactgcgtggttatatgaaggacatgaagcgtatcgccgttggtgattaa

SEQ ID NO: 685 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETAFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 686 - DNA, 1014 bp, Psuedonomas aeruginosa PAO1
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 687 - protein, 338 aa, Psuedonomas aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 688 - DNA, 1014 bp, Pseudonomas fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 689 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 690 - DNA, 23 bp, Artificial Sequence
  Dseq1
aacgcgtgaagcttttgaagatg

SEQ ID NO: 691 - DNA, 20 bp, Artificial Sequence
  Dseq2
tcagttcggaacaatcacgg

SEQ ID NO: 692 - DNA, 27 bp, Artificial Sequence
  Dseq3
tgctttccctttcatcaatgattgttg

SEQ ID NO: 693 - DNA, 23 bp, Artificial Sequence
  Dseq4
tccatgttagccatagcgataac

SEQ ID NO: 694 - DNA, 21 bp, Artificial Sequence
  Dseq5
ttgtgcttcaggagcgatatg

SEQ ID NO: 695 - DNA, 21 bp, Artificial Sequence
  N885
ctgctaatgtggaattgacac

SEQ ID NO: 696 - DNA, 20 bp, Artificial Sequence
  N929
gtctgttacggctcccctag

SEQ ID NO: 697 - protein, 343 aa, Artificial sequence
  Anaerostipes KARI variant-K9JB4P
MEECKMAKIYYQEDCNLSLLDGKTIAVIGYGSQGHAHALNAKESGCNVIIGLYEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 698 - DNA, 12319 bp, artificial sequence
  plasmid pLH689
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 699 - DNA, 12319 bp, artificial sequence
  plasmid pBP3765
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttaattaatcaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaacaatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 700 - DNA, 1713 bp, Streptococcus macacae
  misc_feature (1)..(1713): ilvD
atgactgataaagagaagctgaaaaatttaagaaatcgtagctctgtgtacgattcaatggtcaagtcacccaatcgtgctatgttgcgtgcaactggcatgactgacaaagatttcgaaacacctattgttggtgtgatttctacctgggctgaaaatacaccatgtaacatacatttacatgatttcggaaaactagcaaaagttggtattaaagatgcaggagcatggcccgtacaatttggtacaatcacagttgcagatggtattgctatgggaacccaaggcatgcgtttctccttaacttcacgcgatattatcgctgactcaattgaagcggctatgggaggacataacgctgatgcttttgttgctattggcggctgtgataaaaacatgcccggatctgtcattgctatggctaatatggatatcccagctatctttgcctatggcggtaccattgctcctggcagtttagatggtaaagatattgatttggtatctgtatttgaaggagtcggtcattggaatcatggagatatgactgaagaagaagttaaagctttagaatgcaatgcctgtcctggacctggtggctgtgggggaatgtatactgcaaatactatggcaacagctatcgaagtactaggactcagtcttccaggctcatcatctcatcctgctgaatcggcagataaaaaagctgacattgaagaagctggccgcgctgttgttaaaatgcttgagttaggaattaaaccatcagatattctaacgcgtgaagcttttgaagatgctatcactgtgactatggcattaggaggctccactaactcgacgcttcatcttttggctattgctcatgctgctaatgttgatctaactcttgatgattttaataccttccaagagaaagttcctcatttagctgatttaaaaccatcaggacaatatgttttccaagatctttatgaagctggcggtgttccagcagttatgaaataccttttagctaatggctttctccatggagatcgtataacttgcactggtaaaacagttgctgaaaatttggaaaacttctcagacttagctcccggccaaaaagttatcatgccacttgatcatcctaaacgagctgatggtccccttatcattttacacggcaacttagccccagatggtgctgttgctaaagtctctggtgttaaagttcgccgccatgtcggacctgctaaagtttttaattcagaagaagaagccattgaagccgtattgaatgatgatattgttgatggagatgtcgttgtcgttcggtttgtgggacctaaaggcggtcctggtatgccagaaatgctgtcactatcatctatgattgtcggtaaaggacaaggtgaaaaagtggctctgctcacagacggacggttttctggcggtacttatggattagttgtcggccatattgctcctgaagctcaagatggcggtcctattgcttacctacaaacaggtgatatcgtgacgattgatcaggatacaaaagaattacactttgatatcacagaagaagagttgaaacaccgtcaggaaacaacccagctaccaccgctttattcacgtggagtacttggtaaatacgctcatattgtatcatcagcatccaaaggagctgtaacagacttttggaaaccagaagagactggtaaaaaa

SEQ ID NO: 701 - protein, 571 aa, Streptococcus macacae
  misc_feature (1)..(571): DHAD
MTDKEKLKNLRNRSSVYDSMVKSPNRAMLRATGMTDKDFETPIVGVISTWAENTPCNIHLHDFGKLAKVGIKDAGAWPVQFGTITVADGIAMGTQGMRFSLTSRDIIADSIEAAMGGHNADAFVAIGGCDKNMPGSVIAMANMDIPAIFAYGGTIAPGSLDGKDIDLVSVFEGVGHWNHGDMTEEEVKALECNACPGPGGCGGMYTANTMATAIEVLGLSLPGSSSHPAESADKKADIEEAGRAVVKMLELGIKPSDILTREAFEDAITVTMALGGSTNSTLHLLAIAHAANVDLTLDDFNTFQEKVPHLADLKPSGQYVFQDLYEAGGVPAVMKYLLANGFLHGDRITCTGKTVAENLENFSDLAPGQKVIMPLDHPKRADGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDITEEELKHRQETTQLPPLYSRGVLGKYAHIVSSASKGAVTDFWKPEETGKK

SEQ ID NO: 702 - DNA, 1713 bp, Streptococcus macacae
  misc_feature (1)..(1713): ilvD L2V4
atgactgataaagagaagctgaaaaatttaagaaatcgtagctctgtgtacgattcaatggtcaagtcacccaatcgtgctatgttgcgtgcaactggcatgactgacaaagatttcgaaacacctattgttggtgtgatttctacctgggctgaaaatacaccatgtaacatacatttacatgatttcggaaaactagcaaaagttggtattaaagatgcaggagcatggcccgtacaatttggtacaatcacagttgcagatggtattgctatgggaacccaaggcatgcgtttctccttaacttcacgcgatattatcgctgactcaattgaagcggctatgggaggacataacgctgatgcttttgttgctattggcggctgtgataaaaacatgcccggatctgtcattgctatggctaatatggatatcccagctatctttgcctatggcggtaccattgctcctggcagtttagatggtaaagatattgatttggtatctgtatttgaaggagtcggtcattggaatcatggagatatgactgaagaagaagttaaagctttagaatgcaatgcctgtcctggacctggtggctgtgggggaatgtatactgcaaatactatggcaacagctatcgaagtactaggactcagtcttccaggctcatcatctcatcctgctgaatcggcagataaaaaagctgacattgaagaagctggccgcgctgttgttaaaatgcttgagttaggaattaaaccatcagatattctaacgcgtgaagcttttgaagatgctatcactgtgactatggcattaggaggctccactaactcgacgcttcatcttttggctattgctcatgctgctaatgttgatctaactcttgatgattttaataccttccaagagaaagttcctcatttagctgatttaaaaccatcaggacaatatgttttccaagatctttatgaagctggcggtgttccagcagttatgaaataccttttagctaatggctttctccatggagatcgtataacttgcactggtaaaacagttgctgaaaatttggaaaacttctcagacttagctcccggccaaaaagttatcatgccacttgatcatcctaaacgagctgatggtcccgtcatcattttacacggcaacttagccccagatggtgctgttgctaaagtctctggtgttaaagttcgccgccatgtcggacctgctaaagtttttaattcagaagaagaagccattgaagccgtattgaatgatgatattgttgatggagatgtcgttgtcgttcggtttgtgggacctaaaggcggtcctggtatgccagaaatgctgtcactatcatctatgattgtcggtaaaggacaaggtgaaaaagtggctctgctcacagacggacggttttctggcggtacttatggattagttgtcggccatattgctcctgaagctcaagatggcggtcctattgcttacctacaaacaggtgatatcgtgacgattgatcaggatacaaaagaattacactttgatatcacagaagaagagttgaaacaccgtcaggaaacaacccagctaccaccgctttattcacgtggagtacttggtaaatacgctcatattgtatcatcagcatccaaaggagctgtaacagacttttggaaaccagaagagactggtaaaaaa

SEQ ID NO: 703 - protein, 571 aa, Streptococcus macacae
  misc_feature (1)..(571): DHAD L2V4
MTDKEKLKNLRNRSSVYDSMVKSPNRAMLRATGMTDKDFETPIVGVISTWAENTPCNIHLHDFGKLAKVGIKDAGAWPVQFGTITVADGIAMGTQGMRFSLTSRDIIADSIEAAMGGHNADAFVAIGGCDKNMPGSVIAMANMDIPAIFAYGGTIAPGSLDGKDIDLVSVFEGVGHWNHGDMTEEEVKALECNACPGPGGCGGMYTANTMATAIEVLGLSLPGSSSHPAESADKKADIEEAGRAVVKMLELGIKPSDILTREAFEDAITVTMALGGSTNSTLHLLAIAHAANVDLTLDDFNTFQEKVPHLADLKPSGQYVFQDLYEAGGVPAVMKYLLANGFLHGDRITCTGKTVAENLENFSDLAPGQKVIMPLDHPKRADGPVIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDITEEELKHRQETTQLPPLYSRGVLGKYAHIVSSASKGAVTDFWKPEETGKK

SEQ ID NO: 704 - DNA, 1713 bp, Streptococcus macacae
  misc_feature (1)..(1713): ilvD I2V5
atgactgataaagagaagctgaaaaatttaagaaatcgtagctctgtgtacgattcaatggtcaagtcacccaatcgtgctatgttgcgtgcaactggcatgactgacaaagatttcgaaacacctattgttggtgtgatttctacctgggctgaaaatacaccatgtaacatacatttacatgatttcggaaaactagcaaaagttggtattaaagatgcaggagcatggcccgtacaatttggtacaatcacagttgcagatggtattgctatgggaacccaaggcatgcgtttctccttaacttcacgcgatattatcgctgactcaattgaagcggctatgggaggacataacgctgatgcttttgttgctattggcggctgtgataaaaacatgcccggatctgtcattgctatggctaatatggatatcccagctatctttgcctatggcggtaccattgctcctggcagtttagatggtaaagatattgatttggtatctgtatttgaaggagtcggtcattggaatcatggagatatgactgaagaagaagttaaagctttagaatgcaatgcctgtcctggacctggtggctgtgggggaatgtatactgcaaatactatggcaacagctatcgaagtactaggactcagtcttccaggctcatcatctcatcctgctgaatcggcagataaaaaagctgacattgaagaagctggccgcgctgttgttaaaatgcttgagttaggaattaaaccatcagatattctaacgcgtgaagcttttgaagatgctatcactgtgactatggcattaggaggctccactaactcgacgcttcatcttttggctattgctcatgctgctaatgttgatctaactcttgatgattttaataccttccaagagaaagttcctcatttagctgatttaaaaccatcaggacaatatgttttccaagatctttatgaagctggcggtgttccagcagttatgaaataccttttagctaatggctttctccatggagatcgtataacttgcactggtaaaacagttgctgaaaatttggaaaacttctcagacttagctcccggccaaaaagttatcatgccacttgatcatcctaaacgagctgatggtccccttatcgttttacacggcaacttagccccagatggtgctgttgctaaagtctctggtgttaaagttcgccgccatgtcggacctgctaaagtttttaattcagaagaagaagccattgaagccgtattgaatgatgatattgttgatggagatgtcgttgtcgttcggtttgtgggacctaaaggcggtcctggtatgccagaaatgctgtcactatcatctatgattgtcggtaaaggacaaggtgaaaaagtggctctgctcacagacggacggttttctggcggtacttatggattagttgtcggccatattgctcctgaagctcaagatggcggtcctattgcttacctacaaacaggtgatatcgtgacgattgatcaggatacaaaagaattacactttgatatcacagaagaagagttgaaacaccgtcaggaaacaacccagctaccaccgctttattcacgtggagtacttggtaaatacgctcatattgtatcatcagcatccaaaggagctgtaacagacttttggaaaccagaagagactggtaaaaaa

SEQ ID NO: 705 - protein, 571 aa, Streptococcus macacae
  misc_feature (1)..(571): DHAD I2V5
MTDKEKLKNLRNRSSVYDSMVKSPNRAMLRATGMTDKDFETPIVGVISTWAENTPCNIHLHDFGKLAKVGIKDAGAWPVQFGTITVADGIAMGTQGMRFSLTSRDIIADSIEAAMGGHNADAFVAIGGCDKNMPGSVIAMANMDIPAIFAYGGTIAPGSLDGKDIDLVSVFEGVGHWNHGDMTEEEVKALECNACPGPGGCGGMYTANTMATAIEVLGLSLPGSSSHPAESADKKADIEEAGRAVVKMLELGIKPSDILTREAFEDAITVTMALGGSTNSTLHLLAIAHAANVDLTLDDFNTFQEKVPHLADLKPSGQYVFQDLYEAGGVPAVMKYLLANGFLHGDRITCTGKTVAENLENFSDLAPGQKVIMPLDHPKRADGPLIVLHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDITEEELKHRQETTQLPPLYSRGVLGKYAHIVSSASKGAVTDFWKPEETGKK

SEQ ID NO: 706 - DNA, 1737 bp, S. mutans
  misc_feature (1)..(1737): DHAD 689-I2V5 variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccggtcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaa

SEQ ID NO: 707 - protein, 578 aa, S. mutans
  misc_feature (1)..(578): DHAD 689-I2V5 variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPVIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKKCCPGCCG

SEQ ID NO: 708 - DNA, 1695 bp, Streptococcus downei
  misc_feature (1)..(1695): DHAD nucleic acid
atgagtgacgatatgaagaaattgagacaccgttctgctgtctacgactccatggttaagtctccaaacagagccatgttgagagctaccggtatgactgacaaggatttcgacactccaatcgttggtgtcatttctacttgggctgaaaacaccccatgtaatatccacctacatgatttcggtaagttggctaaagttggtgtcaaggacgctggtgcctggccagtccaatttggtacaatcaccgtttctgacggtattgctatgggtactcaaggtatgagattctcattgacctctagagatatcattgctgactccatcgaagctgccatgggtggccacaacgtcgatgctttcgttgccattggaggctgtgacaagaacatgccaggttccttgattgctatagccaatatggacatcccagctattttcggttacggtggcactatcgctccaggtaacttggacggtaaggatattgacttggtttctgtcttcgaaggtgttggtcactggaaccatggtgacatgaccgaagaggaagtcagacaaatcgaatgtaacgcttgccccggtccgggtggctgtggtggcatgtacaccgctaacactatggctaccgccatcgaagttttgggtatgtccttaccaggttcttcctcacacccagctgaatctgctgaaaagaaagctgacatcgaggaagctggtagagccgttgtcaacatgttaaagctaggtttgaaaccatccgatatcttgaccagagaagccttcgaagacgctattactgttacaatggctttgggtggttctactaacgctaccttgcacttgttggctatcgcccacgctgccaacgtcgatttaactctagaagacttcaatacctttcaagaaaaggttccacacctagctgatttgaagccatctggtcaatacgtcttccaagacttgtacaacgttggtggtgtcccagctgttatgaagtacttgttggctaacggtttcttgcacggtgacagaatcacctgtactggtaagactgttgccgaaaacttagctgacttcgacgatttgaccccaggtcaaaaggtcatcatgccattggatcaccctaagagagctgacggtccattaataatcctaaagggtaacttggctccagacggtgctgtcgccaaggtttctggtgttaaggtcagacgtcacgaaggtccagctaaggttttcgattctgaagaagacgctatcgaagccgtcttggctgacgatattgttgatggtgacgtggtagtcgtgagatacgtcggtccaaagggtggtcctggtatgcccgaaatgttgtctttaagtagcatgttggtcggtaagggtcaaggtgataaggttgctttgatcactgacggtagattctctggtggtacctacggtttggttgtcggtcacgttgccccagaagctcaagacggtggtccaatcgcttacttgagaactggtgacaccgttatcgtcgatcaagacactaaggaaattaccatgaaggtctccgaagaagaattggaaaggcgtaaggctgaaaccactatcccacctttgtactctagaggtgtcttgggtaagtacgctcacattgtttcttccgcttctaagggtgctgtcactgacttctggaacaagggtgaa

SEQ ID NO: 709 - protein, 565 aa, Streptococcus downei
  misc_feature (1)..(565): DHAD amino acid
MSDDMKKLRHRSAVYDSMVKSPNRAMLRATGMTDKDFDTPIVGVISTWAENTPCNIHLHDFGKLAKVGVKDAGAWPVQFGTITVSDGIAMGTQGMRFSLTSRDIIADSIEAAMGGHNVDAFVAIGGCDKNMPGSLIAIANMDIPAIFGYGGTIAPGNLDGKDIDLVSVFEGVGHWNHGDMTEEEVRQIECNACPGPGGCGGMYTANTMATAIEVLGMSLPGSSSHPAESAEKKADIEEAGRAVVNMLKLGLKPSDILTREAFEDAITVTMALGGSTNATLHLLAIAHAANVDLTLEDFNTFQEKVPHLADLKPSGQYVFQDLYNVGGVPAVMKYLLANGFLHGDRITCTGKTVAENLADFDDLTPGQKVIMPLDHPKRADGPLIILKGNLAPDGAVAKVSGVKVRRHEGPAKVFDSEEDAIEAVLADDIVDGDVVVVRYVGPKGGPGMPEMLSLSSMLVGKGQGDKVALITDGRFSGGTYGLVVGHVAPEAQDGGPIAYLRTGDTVIVDQDTKEITMKVSEEELERRKAETTIPPLYSRGVLGKYAHIVSSASKGAVTDFWNKGE

SEQ ID NO: 710 - DNA, 1683 bp, Oscillatoria species
  misc_feature (1)..(1683): PCC 6506 DHAD nucleic acid
atgtctgaaaacttcagatctcacgttgtcacccaaggtactcaacgttctccaaacagagccatgttgcgtgctgtcggtttcggtgacggtgattttactaagccaatcgttggtgtcgctaacggttactctaccattactccatgtaacatgggtttgaatgacttggctttaaaggccgaattcggtgttaagcaagctggtgccatgccacaaatgtttggtacaataaccatctctgacggtatcagtatgggtactgaaggtatgaagtactctttggtttccagagaagtcatcgctgactctattgaaaccgtttgtaacggtcaatccatggacggtgtcttggctatcggtggctgcgataagaacatgccaggtgctatgattgctatagccagaatgaacatcccagctattttcgtctacggaggcactatcaagccaggtcaccataacggttccgacttgaccgtggtatctgctttcgaagccgttggtcaatactctgctggtaagatcgacaacgctgaattgttagaagtcgaaagaaaggcctgtccaggtgctggttcctgcggtggcatgtacaccgctaacactatgtcttccgctttcgaagccatgggtatgtctttgccatactcaagtactatggctgctgaagacgctgaaaaggccgaatctgctgaaaagtccgctatggttttggtcgaagctatcagatctcaactactgccaagacaaattttgactcgtaaggctttcgaaaacgctatcgccgttattatggctgtcggtggttctaccaacgctgttttgcacttgttggctatcgccaatgctgctggtgttgaattggtcatcgacgatttcgaaactattagagctaaggttccagtcttatgtgacctaaagccttccggtagatacgttgctaccgatttgcaccaagctggtggtatcccacaagtcatgaagatgttgttagacagaggtctattgcacggtgatgctttgactatcacaggtcaaaccattgccgaagttttggctgacgtcccagctgaaccaagatccaaccaagatgttatcagaccttggaatcaccccatgtacgctcaaggtcatttggctatcttgagaggtaacttggctaccgaaggtgctgtcgccaagatcactggtattaagaaagctgttatcaccggtccagctagagtcttcgaatctgaagagaactgtttggacgccatcttggctggtaagattaaagctggtgatgttatcgtcgtgagatacgaaggtccaaagggtggccctggtatgagagaaatgttggctccaacttctgccatcattggtgctggtttgggtgactctgtcggtttgatcactgatggtagattctccggtggtacctacggtatggttgtcggtcacgttgccccagaagctcaagtcggtggtgctatcgctttggttgaagagggtgactctatcaccattgatgctccaggtagattactacaaatcaacatttctgacgctgaattggaaagacgtagggctaactggaaggctccaaaaccaagatacactgttggtgttttggctaagtacgctaagttggttagctcttcctcagttggtgctgtcaccgacctaggtttgggt

SEQ ID NO: 711 - protein, 561 aa, Oscillatoria species
  misc_feature (1)..(561): PCC 6506 amino acid
MSENFRSHVVTQGTQRSPNRAMLRAVGFGDGDFTKPIVGVANGYSTITPCNMGLNDLALKAEFGVKQAGAMPQMFGTITISDGISMGTEGMKYSLVSREVIADSIETVCNGQSMDGVLAIGGCDKNMPGAMIAIARMNIPAIFVYGGTIKPGHHNGSDLTVVSAFEAVGQYSAGKIDNAELLEVERKACPGAGSCGGMYTANTMSSAFEAMGMSLPYSSTMAAEDAEKAESAEKSAMVLVEAIRSQLLPRQILTRKAFENAIAVIMAVGGSTNAVLHLLAIANAAGVELVIDDFETIRAKVPVLCDLKPSGRYVATDLHQAGGIPQVMKMLLDRGLLHGDALTITGQTIAEVLADVPAEPRSNQDVIRPWNHPMYAQGHLAILRGNLATEGAVAKITGIKKAVITGPARVFESEENCLDAILAGKIKAGDVIVVRYEGPKGGPGMREMLAPTSAIIGAGLGDSVGLITDGRFSGGTYGMVVGHVAPEAQVGGAIALVEEGDSITIDAPGRLLQINISDAELERRRANWKAPKPRYTVGVLAKYAKLVSSSSVGAVTDLGLG

SEQ ID NO: 712 - DNA, 1677 bp, Zea mays
  misc_feature (1)..(1677): DHAD nucleic acid
atgccaaagttgaacaaatactctgctagaatcaccgaaccaaagtcccaaggtgcttctcaagctgtcttgtacggtgttggtttgactgacgctgatttgagaaagccacaagtgggtgtttcttccgtctggtacgaaggtaacacttgtaatatgcacttgttaagattggctgaagctgtccgtgacggtgttagagaagctggtatggttggtttcagatttaacaccgtcggtgtttctgacgctatctccatgggtactagaggtatgtgttactccttgcaatctagagacttgatcgctgattctattgaaaccgtcatgggtgcccaacactacgacgctaacatctccattcctggttgtgataagaacatgccaggtaccatcatggctatgggtcgtttgaacagaccatctatcatgatttacggtggcactatcaagccaggtcacttccaaggtaactcttacgacattgtctctgctttccaatgttacggtgaatacgtttctggttccatcactgatgaacaaagaaagaacgttttgagaaattcttgtccaggtgccggtgcttgcggaggcatgtacactgctaacacaatggcttctgctatcgaaaccttaggtatgtccttgccatactcaagtagcactccagctgaagacccattgaagttagaagagtgtagattggctggtaagtacctactggaattactaaagatggacttgaagccaaaagatatcattaccgaaaagtctttgagaaacgccatggtcatcgttatggctttgggtggttctactaacgctgtcctacacttgatcgccattgctagatctgttggtttacacctaaccttggacgatttccaaaaggtctctgaccaagttccattcttagctgatctaaagccatccggtaagtacgtcatggaagacttgcacaagatcggtggcactccagctgttattcattacttgttagaacaaggtctattggacggtgattgtatgaccgtcactgctaagaccttggctgaaaacgctaagatcttcccacctttgtccgaaggtcaacaaataatcagaccattggacaaccccatcaagccaactggtcacatccaaattttatacggtaacttggccccagaaggttccgtcgctaagatcaccggtaaggaaggtttgtacttctctggtccagctttggtttttgaaggtgaagagtccatgatcactgccatttctgaaaacccagctaatttcaagggtaaagttgtcgtgatcagaggtgaaggtccaaagggtggccctggtatgccagaaatgttgacaccaacctctgccatcatgggtgctggtttgggtaaggaatgtgctttactaaccgacggtagattcagtggtggttctcacggtttcgtagtcggtcatatctgcccagaagctcaagaaggtggtccaattggtttggtccaatccggtgacattataaccatcgatgtttctaagagagtcattgacgttgatttgactgaacaacaattggaagaaagacgtaggaagtggacccccccgccttacaagtcaacttctggtgctttgtggaagtacatcaagttggttgccccagcttccagaggttgtgttaccgacgaa

SEQ ID NO: 713 - protein, 559 aa, Zea mays
  misc_feature (1)..(559): DHAD amino acid
MPKLNKYSARITEPKSQGASQAVLYGVGLTDADLRKPQVGVSSVWYEGNTCNMHLLRLAEAVRDGVREAGMVGFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEYVSGSITDEQRKNVLRNSCPGAGACGGMYTANTMASAIETLGMSLPYSSSTPAEDPLKLEECRLAGKYLLELLKMDLKPKDIITEKSLRNAMVIVMALGGSTNAVLHLIAIARSVGLHLTLDDFQKVSDQVPFLADLKPSGKYVMEDLHKIGGTPAVIHYLLEQGLLDGDCMTVTAKTLAENAKIFPPLSEGQQIIRPLDNPIKPTGHIQILYGNLAPEGSVAKITGKEGLYFSGPALVFEGEESMITAISENPANFKGKVVVIRGEGPKGGPGMPEMLTPTSAIMGAGLGKECALLTDGRFSGGSHGFVVGHICPEAQEGGPIGLVQSGDIITIDVSKRVIDVDLTEQQLEERRRKWTPPPYKSTSGALWKYIKLVAPASRGCVTDE

SEQ ID NO: 714 - DNA, 1710 bp, Lactococcus lactis
  misc_feature (1)..(1710): DHAD nucleic acid
atggaattcaagtacaacggtaaggttgaatccgtcgaattgaataagtactctaaaaccttgactcaagacccaacccaaccggctactcaagccatgtactacggtatcggtttcaaggatgaagactttaagaaagctcaagttggtatcgtctctatggattgggacggtaacccatgtaatatgcacttgggtactttaggttccaagatcaaatcttccgttaaccaaactgacggtctaatcggtttgcaattccacaccatcggtgtctccgacggtattgctaacggtaagttgggtatgagatactctttggtttctagagaagtcatcgctgactctattgaaaccaacgccggtgctgaatactacgacgctatcgttgccattccaggttgcgataagaacatgccaggttctatcattggtatggctaggttgaaccgtccatccatcatggtttacggtggcactattgaacacggtgaatacaagggtgaaaaattgaacatcgtctccgctttcgaatctttgggtcaaaagatcaccggtaacatttccgatgaagactaccacggtgttatctgtaacgctattccaggtcaaggtgcctgcggaggcatgtacactgctaacaccttggctgctgctatcgaaactctaggtatgtctttgccatactcaagtagcaacccagctgtttctcaagaaaagcaagaagagtgtgacgaaatcggtttggctattaagaacttgttagaaaaggacatcaaaccatctgatattatgaccaaggaagctttcgaaaacgccatcactattgtgatggtattgggtggttctaccaacgctgttttgcacataatcgccatggctaatgccatcggtgtcgaaattactcaagacgatttccaaagaatctccgacattaccccagttttgggtgatttcaagccatctggtaagtacatgatggaagacttgcacaagatcggtggcttaccagctgtcctaaagtacctactgaaggaaggtaagttgcacggtgactgtttaacagttaccggtaagaccttggctgaaaacgtcgaaactgccttagatctagacttcgattctcaagacatcatgagaccattgaagaaccctatcaaggctactggtcacttacaaatcctatacggtaacttggctcaaggtggttctgttgctaagatctctggtaaggaaggtgagttctttaagggtaccgctagagtcttcgacggtgaacaacacttcatcgatggtattgaatctggtagattgcatgctggtgacgtcgccgtgatcagaaacattggtccagttggtggccctggtatgcccgaaatgttgaagccaacctctgctttgatcggtgccggtttaggtaagtcctgtgctttgatcaccgacggtagattctctggtggtactcacggtttcgttgtcggtcatatcgttccagaagctgtcgaaggtggtttgatcggtttggttgaagacgatgacattatagaaatcgacgctgttaacaattctatttccttgaaggtctctgatgaagagatcgctaagagacgtgccaactaccaaaagccaacccctaaggctactagaggtgttttggctaagttcgccaagttgactagaccagcttccgaaggttgtgtcaccgacttg

SEQ ID NO: 715 - protein, 570 aa, Lactococcus lactis
  misc_feature (1)..(570): DHAD amino acid
MEFKYNGKVESVELNKYSKTLTQDPTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFESLGQKITGNISDEDYHGVICNAIPGQGACGGMYTANTLAAAIETLGMSLPYSSSNPAVSQEKQEECDEIGLAIKNLLEKDIKPSDIMTKEAFENAITIVMVLGGSTNAVLHIIAMANAIGVEITQDDFQRISDITPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSDEEIAKRRANYQKPTPKATRGVLAKFAKLTRPASEGCVTDL

SEQ ID NO: 716 - DNA, 1695 bp, Neurospora crassa
  misc_feature (1)..(1695): (1) DHAD nucleic acid
atgaacgctcaagaaaagcaattgaacaaggtctccgctaacatcactcaaccaaagtcccaaggtgcttcccaagctatgttgtacgctactggtttgaacgaagacgatatgaacaaggctcaagtcggtatctcttccgtttggtacgaaggtaacccatgtaacatgcacttgttggacttgtccggtttggtcaaggaatctgttgctaaggctggtttggttccaatgagattcaacactatcggtgtctccgacggtatctctatgggtaccactggtatgagatactccttgcaatctagagaaatcatcgctgactctatcgaaaccgttatgaacggtcaatggtacgacgctaacatctctttgccaggttgtgacaagaacatgccaggtgtcttgatcgctatgggtagagttaacagaccatctatcatggtctacggtggtaccatcaagccaggttgtaacatgaagggtgaaaacatcgacatcgtctccgctttccaagcttacggtcaatacatctctggtgaaatcgacgaaaagcaaagattcgatatcatcagaaacgcttgtccaggtggtggtgcttgtggtggtatgtacaccgctaacactatggctaccgctatcgaaactttgggtatgaccttgccaggttcttcctcttacccagctgaatccccagaaaagaagaacgaatgtttgtctgttggtgaagctatcaagaacttgttgagagaagacatcagaccaactgatatcttgaccagacaagctttcgaaaacgctatgatcgttgtcaacatcttgggtggttccactaacgctgttttgcacttgatcgctatcgctgactctgtcggtatcaagttgactatcgacgatttccaagctgtttctgacagaaccccattcttggctgatttgaagccatctggtaagtgggtcatggaagacttgtctaagatcggtggtaccccagctttgttgaagttcttgttgaaggaaggtatcttggacggttccggtatcacctctaccggtaagactatgaaggaaaacgttgaaaagttcccagacttcccaaccgatcaagctatcatcagaccattgtctaacccaatcaaggaaactggtcacatccaaatcttgagaggttccttggctccaggtggttctgttggtaagatcaccggtaaggaaggtttgagattcgaaggtaaggctagatgtttcgactacgaagatggtttcatcgaagctttggaaagaggtgaaatcaagaagggtgaaaagactgttgtcgttatcagatacgaaggtccaaagggtggtccaggtatgccagaaatgttgaagccatcctctgctatcatgggttacggtttgggtaaggacgttgctttgatcactgatggtagattctccggtggttctcacggtttcttgatcggtcacatcgtcccagaagctatggaaggtggtccaatcggtttggttagagacggtgataccatcgtcatcgacgctgaaaagaaggtcttggatttggaagttccagaagaagaattggctaagagaagaaaggaatggaaggctccagaaccaaaggctaagagaggtaccttgagaaagtacgctcaattggttaaggacgcttcctctggttgtgtcactgatgct

SEQ ID NO: 717 - protein, 565 aa, Neurospora crassa
  misc_feature (1)..(565): (1) DHAD protein
MNAQEKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 718 - DNA, 1683 bp, Neurospora crassa
  misc_feature (1)..(1683): (2) DHAD nucleic acid
atgaagcaattgaacaaggtctccgctaacatcactcaaccaaagtcccaaggtgcttcccaagctatgttgtacgctactggtttgaacgaagacgatatgaacaaggctcaagtcggtatctcttccgtttggtacgaaggtaacccatgtaacatgcacttgttggacttgtccggtttggtcaaggaatctgttgctaaggctggtttggttccaatgagattcaacactatcggtgtctccgacggtatctctatgggtaccactggtatgagatactccttgcaatctagagaaatcatcgctgactctatcgaaaccgttatgaacggtcaatggtacgacgctaacatctctttgccaggttgtgacaagaacatgccaggtgtcttgatcgctatgggtagagttaacagaccatctatcatggtctacggtggtaccatcaagccaggttgtaacatgaagggtgaaaacatcgacatcgtctccgctttccaagcttacggtcaatacatctctggtgaaatcgacgaaaagcaaagattcgatatcatcagaaacgcttgtccaggtggtggtgcttgtggtggtatgtacaccgctaacactatggctaccgctatcgaaactttgggtatgaccttgccaggttcttcctcttacccagctgaatccccagaaaagaagaacgaatgtttgtctgttggtgaagctatcaagaacttgttgagagaagacatcagaccaactgatatcttgaccagacaagctttcgaaaacgctatgatcgttgtcaacatcttgggtggttccactaacgctgttttgcacttgatcgctatcgctgactctgtcggtatcaagttgactatcgacgatttccaagctgtttctgacagaaccccattcttggctgatttgaagccatctggtaagtgggtcatggaagacttgtctaagatcggtggtaccccagctttgttgaagttcttgttgaaggaaggtatcttggacggttccggtatcacctctaccggtaagactatgaaggaaaacgttgaaaagttcccagacttcccaaccgatcaagctatcatcagaccattgtctaacccaatcaaggaaactggtcacatccaaatcttgagaggttccttggctccaggtggttctgttggtaagatcaccggtaaggaaggtttgagattcgaaggtaaggctagatgtttcgactacgaagatggtttcatcgaagctttggaaagaggtgaaatcaagaagggtgaaaagactgttgtcgttatcagatacgaaggtccaaagggtggtccaggtatgccagaaatgttgaagccatcctctgctatcatgggttacggtttgggtaaggacgttgctttgatcactgatggtagattctccggtggttctcacggtttcttgatcggtcacatcgtcccagaagctatggaaggtggtccaatcggtttggttagagacggtgataccatcgtcatcgacgctgaaaagaaggtcttggatttggaagttccagaagaagaattggctaagagaagaaaggaatggaaggctccagaaccaaaggctaagagaggtaccttgagaaagtacgctcaattggttaaggacgcttcctctggttgtgtcactgatgct

SEQ ID NO: 719 - protein, 561 aa, Neurospora crassa
  misc_feature (1)..(561): (2) DHAD protein
MKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 720 - protein, 7 aa, artificial sequence
  tag sequence
CCPGCCG

SEQ ID NO: 721 - DNA, 21 bp, artificial sequence
  lumio tag DNA sequence
tgttgtcctggttgctgtggt

SEQ ID NO: 722 - DNA, 1650 bp, Artificial sequence
  Codon-optimized version of the AMN1 gene from CEN.PK2
atgaagctggagcgcgtgagttctaacgggagctttaagcgtggccgtgacatccaaagtttggagagtccgtgtacccgcccattaaagaaaatgtcgccatcaccttcatttacgagcctgaagatggaaaaaccgtttaaggacattgttcgaaaatacgggggtcacctgcaccagtcctcgtataacccaggttcttcaaaagttgaactcgtgcgtccggacctgagcttgaaaacggaccaatcatttttgcagagcagcgtgcagacaaccccgaacaaaaagagttgtaacgagtatctgtccacacccgaagccactccccttaagaacacggccaccgagaatgcgtgggctacgtcaagggtggtgagcgcatcaagcctgtcaatcgtcacgccgaccgaaatcaaaaatatactggttgacgagtttagtgaactaaaacttggtcagcccttaacagcccagcaccaacggagccatgcagttttcgagatacctgagatcgtagagaacataatcaagatgatcgtttccctcgagagcgccaatattccgaaagaacgtccgtgcctgcgtcgcaacccgcagagttatgagcattcccttctgatgtataaagacgaggaacgcgcgaagaaagcatggtccgcggctcaacaactgcgcgatccgccgctggtgggtcataaggaaaaaaaacagggcgctctgtttagctgcatgatggtcaaccgcctgtggttgaatgtcacgcgtccgttcttatttaagtctctgcatttcaaatcagtgcacaacttcaaagaatttctgcgcacaagtcaggaaaccacgcaagtgatgaggccatcgcactttatcctgcataaattgcaccaggtaacgcagccggatattgagagactgtctagaatggaatgccagaacctcaagtggttggaattttatgtatgtccccgtattacacctccactgtcttggttcgacaatttgcataagttagaaaaattaatcatccccggaaacaagaatatcgacgataatttcctcttacggctgtctcagagtattcctaacctgaaacacctcgtgcttcgtgcttgcgacaatgtttccgatagtggtgtagtttgtatcgccctgaactgccctaagctgaagacgttcaacatcggacgtcatcgccgcggcaatctgattacatcagttagcttggttgccctgggtaagtatacgcaagttgagaccgttggttttgcaggctgcgatgtggacgacgcaggcatatgggagttcgcgcgtttaaacgggaaaaacgtcgagcgcctgtcactcaacagttgccggcttttaaccgactatagcttgccaatcctgtttgcccttaatagtttcccgaaccttgcggtgttggaaattcgaaacctcgataaaattacagatgtccgccattttgtgaaatataatctgtggaagaaatcactggatgctcctatcctgattgaggcgtgcgaacgcataacaaagctgattgatcaggaagagaaccgggtcaaacgcataaatagcctggtcgctttaaaggatatgaccgcgtgggtgaacgctgacgatgaaattgaaaacaacgtcgattga

SEQ ID NO: 723 - protein, 7 aa, Artificial sequence
  Artificial peptide tag
CCPGCCG

SEQ ID NO: 724 - protein, 7 aa, Artificial sequence
  Artificial peptide tag
MCPGCCG

SEQ ID NO: 725 - protein, 7 aa, Artificial sequence
  Artificial peptide tag
CMPGCCG

SEQ ID NO: 726 - protein, 7 aa, Artificial sequence
  Artificial peptide tag
CCPGMCG

SEQ ID NO: 727 - protein, 7 aa, Artificial sequence
  Artificial peptide tag
CCPGCMG

SEQ ID NO: 728 - protein, 7 aa, Artificial sequence
  Artificial peptide tag
MCPGMCG

SEQ ID NO: 729 - protein, 7 aa, Artificial sequence
  Artificial peptide tag
MMPGCCG

SEQ ID NO: 730 - protein, 7 aa, Artificial sequence
  Artificial peptide tag
CMPGMCG

SEQ ID NO: 731 - protein, 7 aa, Artificial sequence
  Artificial peptide tag
CMPGCMG

SEQ ID NO: 732 - protein, 7 aa, Artificial sequence
  Artificial peptide tag
CCPGMMG

SEQ ID NO: 733 - protein, 7 aa, Artificial sequence
  Artificial peptide tag
MCPGCMG

SEQ ID NO: 734 - protein, 7 aa, Artificial sequence
  Artificial peptide tag
MMPGMCG

SEQ ID NO: 735 - protein, 7 aa, Artificial sequence
  Artificial peptide tag
CMPGMMG

SEQ ID NO: 736 - protein, 7 aa, Artificial sequence
  Artificial peptide tag
MCPGMMG

SEQ ID NO: 737 - protein, 7 aa, Artificial sequence
  Artificial peptide tag
MMPGCMG

SEQ ID NO: 738 - protein, 7 aa, Artificial sequence
  Artificial peptide tag
MMPGMMG

SEQ ID NO: 739 - protein, 8 aa, Artificial sequence
  Artificial peptide tag
CSCPGCCG

SEQ ID NO: 740 - protein, 8 aa, Artificial sequence
  Artificial peptide tag
CPCPGCCG

SEQ ID NO: 741 - protein, 8 aa, Artificial sequence
  Artificial peptide tag
CECPGCCG

SEQ ID NO: 742 - protein, 8 aa, Artificial sequence
  Artificial peptide tag
CCPGCSCG

SEQ ID NO: 743 - protein, 8 aa, Artificial sequence
  Artificial peptide tag
CCPGCPCG

SEQ ID NO: 744 - protein, 8 aa, Artificial sequence
  Artificial peptide tag
CCPGCECG

SEQ ID NO: 745 - protein, 8 aa, Artificial sequence
  Artificial peptide tag
CCPEGCCG

SEQ ID NO: 746 - protein, 8 aa, Artificial sequence
  Artificial peptide tag
CCPAGCCG

SEQ ID NO: 747 - protein, 6 aa, Artificial sequence
  Lumio tag sequence
CCPGCC

SEQ ID NO: 748 - protein, 7 aa, Artificial sequence
  tag sequence
CCPGCCG

SEQ ID NO: 749 - protein, 7 aa, artificial sequence
  C-terminal tag
CCPGCCG

SEQ ID NO: 750 - protein, 7 aa, artificial sequence
  C-terminal tag
MCPGCCG

SEQ ID NO: 751 - protein, 7 aa, artificial sequence
  C-terminal tag
CMPGCCG

SEQ ID NO: 752 - protein, 7 aa, artificial sequence
  C-terminal tag
CCPGMCG

SEQ ID NO: 753 - protein, 7 aa, artificial sequence
  C-terminal tag
CCPGCMG

SEQ ID NO: 754 - protein, 7 aa, artificial sequence
  C-terminal tag
MCPGMCG

SEQ ID NO: 755 - protein, 7 aa, artificial sequence
  C-terminal tag
MMPGCCG

SEQ ID NO: 756 - protein, 7 aa, artificial sequence
  C-terminal tag
CMPGMCG

SEQ ID NO: 757 - protein, 7 aa, artificial sequence
  C-terminal tag
CMPGCMG

SEQ ID NO: 758 - protein, 7 aa, artificial sequence
  C-terminal tag
CCPGMMG

SEQ ID NO: 759 - protein, 7 aa, artificial sequence
  C-terminal tag
MCPGCMG

SEQ ID NO: 760 - protein, 7 aa, artificial sequence
  C-terminal tag
MMPGMCG

SEQ ID NO: 761 - protein, 7 aa, artificial sequence
  C-terminal tag
CMPGMMG

SEQ ID NO: 762 - protein, 7 aa, artificial sequence
  C-terminal tag
MCPGMMG

SEQ ID NO: 763 - protein, 7 aa, artificial sequence
  C-terminal tag
MMPGCMG

SEQ ID NO: 764 - protein, 7 aa, artificial sequence
  C-terminal tag
MMPGMMG

SEQ ID NO: 765 - protein, 7 aa, artificial sequence
  C-terminal tag
CSCPGCC

SEQ ID NO: 766 - protein, 7 aa, artificial sequence
  C-terminal tag
CPCPGCC

SEQ ID NO: 767 - protein, 7 aa, artificial sequence
  C-terminal tag
CECPGCC

SEQ ID NO: 768 - protein, 7 aa, artificial sequence
  C-terminal tag
CCPGCSC

SEQ ID NO: 769 - protein, 7 aa, artificial sequence
  C-terminal tag
CCPGCPC

SEQ ID NO: 770 - protein, 7 aa, artificial sequence
  C-terminal tag
CCPGCEC

SEQ ID NO: 771 - protein, 7 aa, artificial sequence
  C-terminal tag
CCPEGCC

SEQ ID NO: 772 - protein, 7 aa, artificial sequence
  C-terminal tag
CCPAGCC

SEQ ID NO: 773 - protein, 571 aa, Streptococcus mutans; identical to SEQ ID NO: 168

SEQ ID NO: 774 - protein, 570 aa, Lactococcus lactis; identical to SEQ ID NO: 232

SEQ ID NO: 775 - protein, 565 aa, Streptococcus downei; identical to SEQ ID NO: 709
  misc_feature (1)..(565): DHAD amino acid

SEQ ID NO: 776 - protein, 561 aa, Oscillatoria sp.; identical to SEQ ID NO: 711
  misc_feature (1)..(561): PCC 6506 amino acid

SEQ ID NO: 777 - protein, 559 aa, Zea mays; identical to SEQ ID NO: 713
  misc_feature (1)..(559): DHAD amino acid

SEQ ID NO: 778 - protein, 570 aa, Lactococcus lactis; identical to SEQ ID NO: 715
  misc_feature (1)..(570): DHAD amino acid

SEQ ID NO: 779 - protein, 565 aa, Neurospora crassa; identical to SEQ ID NO: 717
  misc_feature (1)..(565): (1) DHAD protein

SEQ ID NO: 780 - protein, 561 aa, Neurospora crassa; identical to SEQ ID NO: 719
  misc_feature (1)..(561): (2) DHAD protein

SEQ ID NO: 781 - protein, 571 aa, Streptococcus macacae; identical to SEQ ID NO: 701
  misc_feature (1)..(571): DHAD

SEQ ID NO: 782 - protein, 571 aa, Streptococcus macacae; identical to SEQ ID NO: 703
  misc_feature (1)..(571): DHAD L2V4

SEQ ID NO: 783 - protein, 571 aa, Streptococcus macacae; identical to SEQ ID NO: 705
  misc_feature (1)..(571): DHAD I2V5

SEQ ID NO: 784 - protein, 578 aa, S. mutans; identical to SEQ ID NO: 707
  misc_feature (1)..(578): DHAD 689-I2V5 variant

SEQ ID NO: 785 - DNA, 21 bp, Artificial sequence
  lumio tag DNA sequence
tgttgtcctggttgctgtggt

SEQ ID NO: 786 - DNA, 1737 bp, S. mutans; identical to SEQ ID NO: 706
  misc_feature (1)..(1737): DHAD 689-I2V5 variant

SEQ ID NO: 787 - protein, 578 aa, S. mutans; identical to SEQ ID NO: 707
  misc_feature (1)..(578): DHAD 689-I2V5 variant

SEQ ID NO: 788 - DNA, 11361 bp, Artificial sequence
  pHR81 FBA-IlvD(Sm)
ggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgc

SEQ ID NO: 789 - DNA, 11382 bp, Artificial sequence
  pHR81 FBA-IlvD(Sm)-lum
ggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgc

SEQ ID NO: 790 - DNA, 7917 bp, artificial sequence
  plasmid pBP4582
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaataagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 791 - DNA, 7938 bp, artificial sequence
  plasmid pBP1296
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 792 - DNA, 7899 bp, artificial sequence
  plasmid pBP4578
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgagtgacgatatgaagaaattgagacaccgttctgctgtctacgactccatggttaagtctccaaacagagccatgttgagagctaccggtatgactgacaaggatttcgacactccaatcgttggtgtcatttctacttgggctgaaaacaccccatgtaatatccacctacatgatttcggtaagttggctaaagttggtgtcaaggacgctggtgcctggccagtccaatttggtacaatcaccgtttctgacggtattgctatgggtactcaaggtatgagattctcattgacctctagagatatcattgctgactccatcgaagctgccatgggtggccacaacgtcgatgctttcgttgccattggaggctgtgacaagaacatgccaggttccttgattgctatagccaatatggacatcccagctattttcggttacggtggcactatcgctccaggtaacttggacggtaaggatattgacttggtttctgtcttcgaaggtgttggtcactggaaccatggtgacatgaccgaagaggaagtcagacaaatcgaatgtaacgcttgccccggtccgggtggctgtggtggcatgtacaccgctaacactatggctaccgccatcgaagttttgggtatgtccttaccaggttcttcctcacacccagctgaatctgctgaaaagaaagctgacatcgaggaagctggtagagccgttgtcaacatgttaaagctaggtttgaaaccatccgatatcttgaccagagaagccttcgaagacgctattactgttacaatggctttgggtggttctactaacgctaccttgcacttgttggctatcgcccacgctgccaacgtcgatttaactctagaagacttcaatacctttcaagaaaaggttccacacctagctgatttgaagccatctggtcaatacgtcttccaagacttgtacaacgttggtggtgtcccagctgttatgaagtacttgttggctaacggtttcttgcacggtgacagaatcacctgtactggtaagactgttgccgaaaacttagctgacttcgacgatttgaccccaggtcaaaaggtcatcatgccattggatcaccctaagagagctgacggtccattaataatcctaaagggtaacttggctccagacggtgctgtcgccaaggtttctggtgttaaggtcagacgtcacgaaggtccagctaaggttttcgattctgaagaagacgctatcgaagccgtcttggctgacgatattgttgatggtgacgtggtagtcgtgagatacgtcggtccaaagggtggtcctggtatgcccgaaatgttgtctttaagtagcatgttggtcggtaagggtcaaggtgataaggttgctttgatcactgacggtagattctctggtggtacctacggtttggttgtcggtcacgttgccccagaagctcaagacggtggtccaatcgcttacttgagaactggtgacaccgttatcgtcgatcaagacactaaggaaattaccatgaaggtctccgaagaagaattggaaaggcgtaaggctgaaaccactatcccacctttgtactctagaggtgtcttgggtaagtacgctcacattgtttcttccgcttctaagggtgctgtcactgacttctggaacaagggtgaataagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 793 - DNA, 7920 bp, artificial sequence
  plasmid pBP4579
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgagtgacgatatgaagaaattgagacaccgttctgctgtctacgactccatggttaagtctccaaacagagccatgttgagagctaccggtatgactgacaaggatttcgacactccaatcgttggtgtcatttctacttgggctgaaaacaccccatgtaatatccacctacatgatttcggtaagttggctaaagttggtgtcaaggacgctggtgcctggccagtccaatttggtacaatcaccgtttctgacggtattgctatgggtactcaaggtatgagattctcattgacctctagagatatcattgctgactccatcgaagctgccatgggtggccacaacgtcgatgctttcgttgccattggaggctgtgacaagaacatgccaggttccttgattgctatagccaatatggacatcccagctattttcggttacggtggcactatcgctccaggtaacttggacggtaaggatattgacttggtttctgtcttcgaaggtgttggtcactggaaccatggtgacatgaccgaagaggaagtcagacaaatcgaatgtaacgcttgccccggtccgggtggctgtggtggcatgtacaccgctaacactatggctaccgccatcgaagttttgggtatgtccttaccaggttcttcctcacacccagctgaatctgctgaaaagaaagctgacatcgaggaagctggtagagccgttgtcaacatgttaaagctaggtttgaaaccatccgatatcttgaccagagaagccttcgaagacgctattactgttacaatggctttgggtggttctactaacgctaccttgcacttgttggctatcgcccacgctgccaacgtcgatttaactctagaagacttcaatacctttcaagaaaaggttccacacctagctgatttgaagccatctggtcaatacgtcttccaagacttgtacaacgttggtggtgtcccagctgttatgaagtacttgttggctaacggtttcttgcacggtgacagaatcacctgtactggtaagactgttgccgaaaacttagctgacttcgacgatttgaccccaggtcaaaaggtcatcatgccattggatcaccctaagagagctgacggtccattaataatcctaaagggtaacttggctccagacggtgctgtcgccaaggtttctggtgttaaggtcagacgtcacgaaggtccagctaaggttttcgattctgaagaagacgctatcgaagccgtcttggctgacgatattgttgatggtgacgtggtagtcgtgagatacgtcggtccaaagggtggtcctggtatgcccgaaatgttgtctttaagtagcatgttggtcggtaagggtcaaggtgataaggttgctttgatcactgacggtagattctctggtggtacctacggtttggttgtcggtcacgttgccccagaagctcaagacggtggtccaatcgcttacttgagaactggtgacaccgttatcgtcgatcaagacactaaggaaattaccatgaaggtctccgaagaagaattggaaaggcgtaaggctgaaaccactatcccacctttgtactctagaggtgtcttgggtaagtacgctcacattgtttcttccgcttctaagggtgctgtcactgacttctggaacaagggtgaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 794 - DNA, 7887 bp, artificial sequence
  plasmid pBP4580
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgtctgaaaacttcagatctcacgttgtcacccaaggtactcaacgttctccaaacagagccatgttgcgtgctgtcggtttcggtgacggtgattttactaagccaatcgttggtgtcgctaacggttactctaccattactccatgtaacatgggtttgaatgacttggctttaaaggccgaattcggtgttaagcaagctggtgccatgccacaaatgtttggtacaataaccatctctgacggtatcagtatgggtactgaaggtatgaagtactctttggtttccagagaagtcatcgctgactctattgaaaccgtttgtaacggtcaatccatggacggtgtcttggctatcggtggctgcgataagaacatgccaggtgctatgattgctatagccagaatgaacatcccagctattttcgtctacggaggcactatcaagccaggtcaccataacggttccgacttgaccgtggtatctgctttcgaagccgttggtcaatactctgctggtaagatcgacaacgctgaattgttagaagtcgaaagaaaggcctgtccaggtgctggttcctgcggtggcatgtacaccgctaacactatgtcttccgctttcgaagccatgggtatgtctttgccatactcaagtactatggctgctgaagacgctgaaaaggccgaatctgctgaaaagtccgctatggttttggtcgaagctatcagatctcaactactgccaagacaaattttgactcgtaaggctttcgaaaacgctatcgccgttattatggctgtcggtggttctaccaacgctgttttgcacttgttggctatcgccaatgctgctggtgttgaattggtcatcgacgatttcgaaactattagagctaaggttccagtcttatgtgacctaaagccttccggtagatacgttgctaccgatttgcaccaagctggtggtatcccacaagtcatgaagatgttgttagacagaggtctattgcacggtgatgctttgactatcacaggtcaaaccattgccgaagttttggctgacgtcccagctgaaccaagatccaaccaagatgttatcagaccttggaatcaccccatgtacgctcaaggtcatttggctatcttgagaggtaacttggctaccgaaggtgctgtcgccaagatcactggtattaagaaagctgttatcaccggtccagctagagtcttcgaatctgaagagaactgtttggacgccatcttggctggtaagattaaagctggtgatgttatcgtcgtgagatacgaaggtccaaagggtggccctggtatgagagaaatgttggctccaacttctgccatcattggtgctggtttgggtgactctgtcggtttgatcactgatggtagattctccggtggtacctacggtatggttgtcggtcacgttgccccagaagctcaagtcggtggtgctatcgctttggttgaagagggtgactctatcaccattgatgctccaggtagattactacaaatcaacatttctgacgctgaattggaaagacgtagggctaactggaaggctccaaaaccaagatacactgttggtgttttggctaagtacgctaagttggttagctcttcctcagttggtgctgtcaccgacctaggtttgggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 795 - DNA, 7908 bp, artificial sequence
  plasmid pBP4581
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgtctgaaaacttcagatctcacgttgtcacccaaggtactcaacgttctccaaacagagccatgttgcgtgctgtcggtttcggtgacggtgattttactaagccaatcgttggtgtcgctaacggttactctaccattactccatgtaacatgggtttgaatgacttggctttaaaggccgaattcggtgttaagcaagctggtgccatgccacaaatgtttggtacaataaccatctctgacggtatcagtatgggtactgaaggtatgaagtactctttggtttccagagaagtcatcgctgactctattgaaaccgtttgtaacggtcaatccatggacggtgtcttggctatcggtggctgcgataagaacatgccaggtgctatgattgctatagccagaatgaacatcccagctattttcgtctacggaggcactatcaagccaggtcaccataacggttccgacttgaccgtggtatctgctttcgaagccgttggtcaatactctgctggtaagatcgacaacgctgaattgttagaagtcgaaagaaaggcctgtccaggtgctggttcctgcggtggcatgtacaccgctaacactatgtcttccgctttcgaagccatgggtatgtctttgccatactcaagtactatggctgctgaagacgctgaaaaggccgaatctgctgaaaagtccgctatggttttggtcgaagctatcagatctcaactactgccaagacaaattttgactcgtaaggctttcgaaaacgctatcgccgttattatggctgtcggtggttctaccaacgctgttttgcacttgttggctatcgccaatgctgctggtgttgaattggtcatcgacgatttcgaaactattagagctaaggttccagtcttatgtgacctaaagccttccggtagatacgttgctaccgatttgcaccaagctggtggtatcccacaagtcatgaagatgttgttagacagaggtctattgcacggtgatgctttgactatcacaggtcaaaccattgccgaagttttggctgacgtcccagctgaaccaagatccaaccaagatgttatcagaccttggaatcaccccatgtacgctcaaggtcatttggctatcttgagaggtaacttggctaccgaaggtgctgtcgccaagatcactggtattaagaaagctgttatcaccggtccagctagagtcttcgaatctgaagagaactgtttggacgccatcttggctggtaagattaaagctggtgatgttatcgtcgtgagatacgaaggtccaaagggtggccctggtatgagagaaatgttggctccaacttctgccatcattggtgctggtttgggtgactctgtcggtttgatcactgatggtagattctccggtggtacctacggtatggttgtcggtcacgttgccccagaagctcaagtcggtggtgctatcgctttggttgaagagggtgactctatcaccattgatgctccaggtagattactacaaatcaacatttctgacgctgaattggaaagacgtagggctaactggaaggctccaaaaccaagatacactgttggtgttttggctaagtacgctaagttggttagctcttcctcagttggtgctgtcaccgacctaggtttgggttgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 796 - DNA, 7881 bp, artificial sequence
  plasmid pBP4585
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgccaaagttgaacaaatactctgctagaatcaccgaaccaaagtcccaaggtgcttctcaagctgtcttgtacggtgttggtttgactgacgctgatttgagaaagccacaagtgggtgtttcttccgtctggtacgaaggtaacacttgtaatatgcacttgttaagattggctgaagctgtccgtgacggtgttagagaagctggtatggttggtttcagatttaacaccgtcggtgtttctgacgctatctccatgggtactagaggtatgtgttactccttgcaatctagagacttgatcgctgattctattgaaaccgtcatgggtgcccaacactacgacgctaacatctccattcctggttgtgataagaacatgccaggtaccatcatggctatgggtcgtttgaacagaccatctatcatgatttacggtggcactatcaagccaggtcacttccaaggtaactcttacgacattgtctctgctttccaatgttacggtgaatacgtttctggttccatcactgatgaacaaagaaagaacgttttgagaaattcttgtccaggtgccggtgcttgcggaggcatgtacactgctaacacaatggcttctgctatcgaaaccttaggtatgtccttgccatactcaagtagcactccagctgaagacccattgaagttagaagagtgtagattggctggtaagtacctactggaattactaaagatggacttgaagccaaaagatatcattaccgaaaagtctttgagaaacgccatggtcatcgttatggctttgggtggttctactaacgctgtcctacacttgatcgccattgctagatctgttggtttacacctaaccttggacgatttccaaaaggtctctgaccaagttccattcttagctgatctaaagccatccggtaagtacgtcatggaagacttgcacaagatcggtggcactccagctgttattcattacttgttagaacaaggtctattggacggtgattgtatgaccgtcactgctaagaccttggctgaaaacgctaagatcttcccacctttgtccgaaggtcaacaaataatcagaccattggacaaccccatcaagccaactggtcacatccaaattttatacggtaacttggccccagaaggttccgtcgctaagatcaccggtaaggaaggtttgtacttctctggtccagctttggtttttgaaggtgaagagtccatgatcactgccatttctgaaaacccagctaatttcaagggtaaagttgtcgtgatcagaggtgaaggtccaaagggtggccctggtatgccagaaatgttgacaccaacctctgccatcatgggtgctggtttgggtaaggaatgtgctttactaaccgacggtagattcagtggtggttctcacggtttcgtagtcggtcatatctgcccagaagctcaagaaggtggtccaattggtttggtccaatccggtgacattataaccatcgatgtttctaagagagtcattgacgttgatttgactgaacaacaattggaagaaagacgtaggaagtggacccccccgccttacaagtcaacttctggtgctttgtggaagtacatcaagttggttgccccagcttccagaggttgtgttaccgacgaataagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 797 - DNA, 7902 bp, artificial sequence
  plasmid pBP4586
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgccaaagttgaacaaatactctgctagaatcaccgaaccaaagtcccaaggtgcttctcaagctgtcttgtacggtgttggtttgactgacgctgatttgagaaagccacaagtgggtgtttcttccgtctggtacgaaggtaacacttgtaatatgcacttgttaagattggctgaagctgtccgtgacggtgttagagaagctggtatggttggtttcagatttaacaccgtcggtgtttctgacgctatctccatgggtactagaggtatgtgttactccttgcaatctagagacttgatcgctgattctattgaaaccgtcatgggtgcccaacactacgacgctaacatctccattcctggttgtgataagaacatgccaggtaccatcatggctatgggtcgtttgaacagaccatctatcatgatttacggtggcactatcaagccaggtcacttccaaggtaactcttacgacattgtctctgctttccaatgttacggtgaatacgtttctggttccatcactgatgaacaaagaaagaacgttttgagaaattcttgtccaggtgccggtgcttgcggaggcatgtacactgctaacacaatggcttctgctatcgaaaccttaggtatgtccttgccatactcaagtagcactccagctgaagacccattgaagttagaagagtgtagattggctggtaagtacctactggaattactaaagatggacttgaagccaaaagatatcattaccgaaaagtctttgagaaacgccatggtcatcgttatggctttgggtggttctactaacgctgtcctacacttgatcgccattgctagatctgttggtttacacctaaccttggacgatttccaaaaggtctctgaccaagttccattcttagctgatctaaagccatccggtaagtacgtcatggaagacttgcacaagatcggtggcactccagctgttattcattacttgttagaacaaggtctattggacggtgattgtatgaccgtcactgctaagaccttggctgaaaacgctaagatcttcccacctttgtccgaaggtcaacaaataatcagaccattggacaaccccatcaagccaactggtcacatccaaattttatacggtaacttggccccagaaggttccgtcgctaagatcaccggtaaggaaggtttgtacttctctggtccagctttggtttttgaaggtgaagagtccatgatcactgccatttctgaaaacccagctaatttcaagggtaaagttgtcgtgatcagaggtgaaggtccaaagggtggccctggtatgccagaaatgttgacaccaacctctgccatcatgggtgctggtttgggtaaggaatgtgctttactaaccgacggtagattcagtggtggttctcacggtttcgtagtcggtcatatctgcccagaagctcaagaaggtggtccaattggtttggtccaatccggtgacattataaccatcgatgtttctaagagagtcattgacgttgatttgactgaacaacaattggaagaaagacgtaggaagtggacccccccgccttacaagtcaacttctggtgctttgtggaagtacatcaagttggttgccccagcttccagaggttgtgttaccgacgaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 798 - DNA, 7914 bp, artificial sequence
  plasmid pBP4587
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatggaattcaagtacaacggtaaggttgaatccgtcgaattgaataagtactctaaaaccttgactcaagacccaacccaaccggctactcaagccatgtactacggtatcggtttcaaggatgaagactttaagaaagctcaagttggtatcgtctctatggattgggacggtaacccatgtaatatgcacttgggtactttaggttccaagatcaaatcttccgttaaccaaactgacggtctaatcggtttgcaattccacaccatcggtgtctccgacggtattgctaacggtaagttgggtatgagatactctttggtttctagagaagtcatcgctgactctattgaaaccaacgccggtgctgaatactacgacgctatcgttgccattccaggttgcgataagaacatgccaggttctatcattggtatggctaggttgaaccgtccatccatcatggtttacggtggcactattgaacacggtgaatacaagggtgaaaaattgaacatcgtctccgctttcgaatctttgggtcaaaagatcaccggtaacatttccgatgaagactaccacggtgttatctgtaacgctattccaggtcaaggtgcctgcggaggcatgtacactgctaacaccttggctgctgctatcgaaactctaggtatgtctttgccatactcaagtagcaacccagctgtttctcaagaaaagcaagaagagtgtgacgaaatcggtttggctattaagaacttgttagaaaaggacatcaaaccatctgatattatgaccaaggaagctttcgaaaacgccatcactattgtgatggtattgggtggttctaccaacgctgttttgcacataatcgccatggctaatgccatcggtgtcgaaattactcaagacgatttccaaagaatctccgacattaccccagttttgggtgatttcaagccatctggtaagtacatgatggaagacttgcacaagatcggtggcttaccagctgtcctaaagtacctactgaaggaaggtaagttgcacggtgactgtttaacagttaccggtaagaccttggctgaaaacgtcgaaactgccttagatctagacttcgattctcaagacatcatgagaccattgaagaaccctatcaaggctactggtcacttacaaatcctatacggtaacttggctcaaggtggttctgttgctaagatctctggtaaggaaggtgagttctttaagggtaccgctagagtcttcgacggtgaacaacacttcatcgatggtattgaatctggtagattgcatgctggtgacgtcgccgtgatcagaaacattggtccagttggtggccctggtatgcccgaaatgttgaagccaacctctgctttgatcggtgccggtttaggtaagtcctgtgctttgatcaccgacggtagattctctggtggtactcacggtttcgttgtcggtcatatcgttccagaagctgtcgaaggtggtttgatcggtttggttgaagacgatgacattatagaaatcgacgctgttaacaattctatttccttgaaggtctctgatgaagagatcgctaagagacgtgccaactaccaaaagccaacccctaaggctactagaggtgttttggctaagttcgccaagttgactagaccagcttccgaaggttgtgtcaccgacttgtaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 799 - DNA, 7935 bp, artificial sequence
  plasmid pBP4588
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatggaattcaagtacaacggtaaggttgaatccgtcgaattgaataagtactctaaaaccttgactcaagacccaacccaaccggctactcaagccatgtactacggtatcggtttcaaggatgaagactttaagaaagctcaagttggtatcgtctctatggattgggacggtaacccatgtaatatgcacttgggtactttaggttccaagatcaaatcttccgttaaccaaactgacggtctaatcggtttgcaattccacaccatcggtgtctccgacggtattgctaacggtaagttgggtatgagatactctttggtttctagagaagtcatcgctgactctattgaaaccaacgccggtgctgaatactacgacgctatcgttgccattccaggttgcgataagaacatgccaggttctatcattggtatggctaggttgaaccgtccatccatcatggtttacggtggcactattgaacacggtgaatacaagggtgaaaaattgaacatcgtctccgctttcgaatctttgggtcaaaagatcaccggtaacatttccgatgaagactaccacggtgttatctgtaacgctattccaggtcaaggtgcctgcggaggcatgtacactgctaacaccttggctgctgctatcgaaactctaggtatgtctttgccatactcaagtagcaacccagctgtttctcaagaaaagcaagaagagtgtgacgaaatcggtttggctattaagaacttgttagaaaaggacatcaaaccatctgatattatgaccaaggaagctttcgaaaacgccatcactattgtgatggtattgggtggttctaccaacgctgttttgcacataatcgccatggctaatgccatcggtgtcgaaattactcaagacgatttccaaagaatctccgacattaccccagttttgggtgatttcaagccatctggtaagtacatgatggaagacttgcacaagatcggtggcttaccagctgtcctaaagtacctactgaaggaaggtaagttgcacggtgactgtttaacagttaccggtaagaccttggctgaaaacgtcgaaactgccttagatctagacttcgattctcaagacatcatgagaccattgaagaaccctatcaaggctactggtcacttacaaatcctatacggtaacttggctcaaggtggttctgttgctaagatctctggtaaggaaggtgagttctttaagggtaccgctagagtcttcgacggtgaacaacacttcatcgatggtattgaatctggtagattgcatgctggtgacgtcgccgtgatcagaaacattggtccagttggtggccctggtatgcccgaaatgttgaagccaacctctgctttgatcggtgccggtttaggtaagtcctgtgctttgatcaccgacggtagattctctggtggtactcacggtttcgttgtcggtcatatcgttccagaagctgtcgaaggtggtttgatcggtttggttgaagacgatgacattatagaaatcgacgctgttaacaattctatttccttgaaggtctctgatgaagagatcgctaagagacgtgccaactaccaaaagccaacccctaaggctactagaggtgttttggctaagttcgccaagttgactagaccagcttccgaaggttgtgtcaccgacttgtgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 800 - DNA, 7899 bp, artificial sequence
  plasmid pBP4642
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgaacgctcaagaaaagcaattgaacaaggtctccgctaacatcactcaaccaaagtcccaaggtgcttcccaagctatgttgtacgctactggtttgaacgaagacgatatgaacaaggctcaagtcggtatctcttccgtttggtacgaaggtaacccatgtaacatgcacttgttggacttgtccggtttggtcaaggaatctgttgctaaggctggtttggttccaatgagattcaacactatcggtgtctccgacggtatctctatgggtaccactggtatgagatactccttgcaatctagagaaatcatcgctgactctatcgaaaccgttatgaacggtcaatggtacgacgctaacatctctttgccaggttgtgacaagaacatgccaggtgtcttgatcgctatgggtagagttaacagaccatctatcatggtctacggtggtaccatcaagccaggttgtaacatgaagggtgaaaacatcgacatcgtctccgctttccaagcttacggtcaatacatctctggtgaaatcgacgaaaagcaaagattcgatatcatcagaaacgcttgtccaggtggtggtgcttgtggtggtatgtacaccgctaacactatggctaccgctatcgaaactttgggtatgaccttgccaggttcttcctcttacccagctgaatccccagaaaagaagaacgaatgtttgtctgttggtgaagctatcaagaacttgttgagagaagacatcagaccaactgatatcttgaccagacaagctttcgaaaacgctatgatcgttgtcaacatcttgggtggttccactaacgctgttttgcacttgatcgctatcgctgactctgtcggtatcaagttgactatcgacgatttccaagctgtttctgacagaaccccattcttggctgatttgaagccatctggtaagtgggtcatggaagacttgtctaagatcggtggtaccccagctttgttgaagttcttgttgaaggaaggtatcttggacggttccggtatcacctctaccggtaagactatgaaggaaaacgttgaaaagttcccagacttcccaaccgatcaagctatcatcagaccattgtctaacccaatcaaggaaactggtcacatccaaatcttgagaggttccttggctccaggtggttctgttggtaagatcaccggtaaggaaggtttgagattcgaaggtaaggctagatgtttcgactacgaagatggtttcatcgaagctttggaaagaggtgaaatcaagaagggtgaaaagactgttgtcgttatcagatacgaaggtccaaagggtggtccaggtatgccagaaatgttgaagccatcctctgctatcatgggttacggtttgggtaaggacgttgctttgatcactgatggtagattctccggtggttctcacggtttcttgatcggtcacatcgtcccagaagctatggaaggtggtccaatcggtttggttagagacggtgataccatcgtcatcgacgctgaaaagaaggtcttggatttggaagttccagaagaagaattggctaagagaagaaaggaatggaaggctccagaaccaaaggctaagagaggtaccttgagaaagtacgctcaattggttaaggacgcttcctctggttgtgtcactgatgcttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 801 - DNA, 7920 bp, artificial sequence
  plasmid pBP4644
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgaacgctcaagaaaagcaattgaacaaggtctccgctaacatcactcaaccaaagtcccaaggtgcttcccaagctatgttgtacgctactggtttgaacgaagacgatatgaacaaggctcaagtcggtatctcttccgtttggtacgaaggtaacccatgtaacatgcacttgttggacttgtccggtttggtcaaggaatctgttgctaaggctggtttggttccaatgagattcaacactatcggtgtctccgacggtatctctatgggtaccactggtatgagatactccttgcaatctagagaaatcatcgctgactctatcgaaaccgttatgaacggtcaatggtacgacgctaacatctctttgccaggttgtgacaagaacatgccaggtgtcttgatcgctatgggtagagttaacagaccatctatcatggtctacggtggtaccatcaagccaggttgtaacatgaagggtgaaaacatcgacatcgtctccgctttccaagcttacggtcaatacatctctggtgaaatcgacgaaaagcaaagattcgatatcatcagaaacgcttgtccaggtggtggtgcttgtggtggtatgtacaccgctaacactatggctaccgctatcgaaactttgggtatgaccttgccaggttcttcctcttacccagctgaatccccagaaaagaagaacgaatgtttgtctgttggtgaagctatcaagaacttgttgagagaagacatcagaccaactgatatcttgaccagacaagctttcgaaaacgctatgatcgttgtcaacatcttgggtggttccactaacgctgttttgcacttgatcgctatcgctgactctgtcggtatcaagttgactatcgacgatttccaagctgtttctgacagaaccccattcttggctgatttgaagccatctggtaagtgggtcatggaagacttgtctaagatcggtggtaccccagctttgttgaagttcttgttgaaggaaggtatcttggacggttccggtatcacctctaccggtaagactatgaaggaaaacgttgaaaagttcccagacttcccaaccgatcaagctatcatcagaccattgtctaacccaatcaaggaaactggtcacatccaaatcttgagaggttccttggctccaggtggttctgttggtaagatcaccggtaaggaaggtttgagattcgaaggtaaggctagatgtttcgactacgaagatggtttcatcgaagctttggaaagaggtgaaatcaagaagggtgaaaagactgttgtcgttatcagatacgaaggtccaaagggtggtccaggtatgccagaaatgttgaagccatcctctgctatcatgggttacggtttgggtaaggacgttgctttgatcactgatggtagattctccggtggttctcacggtttcttgatcggtcacatcgtcccagaagctatggaaggtggtccaatcggtttggttagagacggtgataccatcgtcatcgacgctgaaaagaaggtcttggatttggaagttccagaagaagaattggctaagagaagaaaggaatggaaggctccagaaccaaaggctaagagaggtaccttgagaaagtacgctcaattggttaaggacgcttcctctggttgtgtcactgatgcttgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 802 - DNA, 7887 bp, artificial sequence
  plasmid pBP4643
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgaagcaattgaacaaggtctccgctaacatcactcaaccaaagtcccaaggtgcttcccaagctatgttgtacgctactggtttgaacgaagacgatatgaacaaggctcaagtcggtatctcttccgtttggtacgaaggtaacccatgtaacatgcacttgttggacttgtccggtttggtcaaggaatctgttgctaaggctggtttggttccaatgagattcaacactatcggtgtctccgacggtatctctatgggtaccactggtatgagatactccttgcaatctagagaaatcatcgctgactctatcgaaaccgttatgaacggtcaatggtacgacgctaacatctctttgccaggttgtgacaagaacatgccaggtgtcttgatcgctatgggtagagttaacagaccatctatcatggtctacggtggtaccatcaagccaggttgtaacatgaagggtgaaaacatcgacatcgtctccgctttccaagcttacggtcaatacatctctggtgaaatcgacgaaaagcaaagattcgatatcatcagaaacgcttgtccaggtggtggtgcttgtggtggtatgtacaccgctaacactatggctaccgctatcgaaactttgggtatgaccttgccaggttcttcctcttacccagctgaatccccagaaaagaagaacgaatgtttgtctgttggtgaagctatcaagaacttgttgagagaagacatcagaccaactgatatcttgaccagacaagctttcgaaaacgctatgatcgttgtcaacatcttgggtggttccactaacgctgttttgcacttgatcgctatcgctgactctgtcggtatcaagttgactatcgacgatttccaagctgtttctgacagaaccccattcttggctgatttgaagccatctggtaagtgggtcatggaagacttgtctaagatcggtggtaccccagctttgttgaagttcttgttgaaggaaggtatcttggacggttccggtatcacctctaccggtaagactatgaaggaaaacgttgaaaagttcccagacttcccaaccgatcaagctatcatcagaccattgtctaacccaatcaaggaaactggtcacatccaaatcttgagaggttccttggctccaggtggttctgttggtaagatcaccggtaaggaaggtttgagattcgaaggtaaggctagatgtttcgactacgaagatggtttcatcgaagctttggaaagaggtgaaatcaagaagggtgaaaagactgttgtcgttatcagatacgaaggtccaaagggtggtccaggtatgccagaaatgttgaagccatcctctgctatcatgggttacggtttgggtaaggacgttgctttgatcactgatggtagattctccggtggttctcacggtttcttgatcggtcacatcgtcccagaagctatggaaggtggtccaatcggtttggttagagacggtgataccatcgtcatcgacgctgaaaagaaggtcttggatttggaagttccagaagaagaattggctaagagaagaaaggaatggaaggctccagaaccaaaggctaagagaggtaccttgagaaagtacgctcaattggttaaggacgcttcctctggttgtgtcactgatgcttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 803 - DNA, 7908 bp, artificial sequence
  plasmid pBP4645
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgaagcaattgaacaaggtctccgctaacatcactcaaccaaagtcccaaggtgcttcccaagctatgttgtacgctactggtttgaacgaagacgatatgaacaaggctcaagtcggtatctcttccgtttggtacgaaggtaacccatgtaacatgcacttgttggacttgtccggtttggtcaaggaatctgttgctaaggctggtttggttccaatgagattcaacactatcggtgtctccgacggtatctctatgggtaccactggtatgagatactccttgcaatctagagaaatcatcgctgactctatcgaaaccgttatgaacggtcaatggtacgacgctaacatctctttgccaggttgtgacaagaacatgccaggtgtcttgatcgctatgggtagagttaacagaccatctatcatggtctacggtggtaccatcaagccaggttgtaacatgaagggtgaaaacatcgacatcgtctccgctttccaagcttacggtcaatacatctctggtgaaatcgacgaaaagcaaagattcgatatcatcagaaacgcttgtccaggtggtggtgcttgtggtggtatgtacaccgctaacactatggctaccgctatcgaaactttgggtatgaccttgccaggttcttcctcttacccagctgaatccccagaaaagaagaacgaatgtttgtctgttggtgaagctatcaagaacttgttgagagaagacatcagaccaactgatatcttgaccagacaagctttcgaaaacgctatgatcgttgtcaacatcttgggtggttccactaacgctgttttgcacttgatcgctatcgctgactctgtcggtatcaagttgactatcgacgatttccaagctgtttctgacagaaccccattcttggctgatttgaagccatctggtaagtgggtcatggaagacttgtctaagatcggtggtaccccagctttgttgaagttcttgttgaaggaaggtatcttggacggttccggtatcacctctaccggtaagactatgaaggaaaacgttgaaaagttcccagacttcccaaccgatcaagctatcatcagaccattgtctaacccaatcaaggaaactggtcacatccaaatcttgagaggttccttggctccaggtggttctgttggtaagatcaccggtaaggaaggtttgagattcgaaggtaaggctagatgtttcgactacgaagatggtttcatcgaagctttggaaagaggtgaaatcaagaagggtgaaaagactgttgtcgttatcagatacgaaggtccaaagggtggtccaggtatgccagaaatgttgaagccatcctctgctatcatgggttacggtttgggtaaggacgttgctttgatcactgatggtagattctccggtggttctcacggtttcttgatcggtcacatcgtcccagaagctatggaaggtggtccaatcggtttggttagagacggtgataccatcgtcatcgacgctgaaaagaaggtcttggatttggaagttccagaagaagaattggctaagagaagaaaggaatggaaggctccagaaccaaaggctaagagaggtaccttgagaaagtacgctcaattggttaaggacgcttcctctggttgtgtcactgatgcttgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 804 - DNA, 6195 bp, artificial sequence
  plasmid pBP4577
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 805 - DNA, 33 bp, artificial sequence
  primer ilvD_F1
gtgagtatgactgacaaaaaaactcttaaagac

SEQ ID NO: 806 - DNA, 40 bp, artificial sequence
  primer Lum_R1
attaatcaaccacagcaaccaggacaacattttttgccag

SEQ ID NO: 807 - DNA, 40 bp, artificial sequence
  primer Lum_R2
attaatcaaccacagcaaccaggacacatttttttgccag

SEQ ID NO: 808 - DNA, 40 bp, artificial sequence
  primer Lum_R3
attaatcaaccacagcaaccaggcatacattttttgccag

SEQ ID NO: 809 - DNA, 40 bp, artificial sequence
  primer Lum_R4
attaatcaaccacacataccaggacaacattttttgccag

SEQ ID NO: 810 - DNA, 40 bp, artificial sequence
  primer Lum_R5
attaatcaacccatgcaaccaggacaacattttttgccag

SEQ ID NO: 811 - DNA, 40 bp, artificial sequence
  primer Lum_R6
attaatcaaccacacataccaggacacatttttttgccag

SEQ ID NO: 812 - DNA, 40 bp, artificial sequence
  primer Lum_R7
attaatcaaccacagcaaccaggcatcatttttttgccag

SEQ ID NO: 813 - DNA, 40 bp, artificial sequence
  primer Lum_R8
attaatcaaccacacataccaggcatacattttttgccag

SEQ ID NO: 814 - DNA, 40 bp, artificial sequence
  primer Lum_R9
attaatcaacccatgcaaccaggcatacattttttgccag

SEQ ID NO: 815 - DNA, 40 bp, artificial sequence
  primer Lum_R10
attaatcaacccatcataccaggacaacattttttgccag

SEQ ID NO: 816 - DNA, 40 bp, artificial sequence
  primer Lum_R11
attaatcaacccatgcaaccaggacacatttttttgccag

SEQ ID NO: 817 - DNA, 40 bp, artificial sequence
  primer Lum_R12
attaatcaaccacacataccaggcatcatttttttgccag

SEQ ID NO: 818 - DNA, 40 bp, artificial sequence
  primer Lum_R13
attaatcaacccatcataccaggcatacattttttgccag

SEQ ID NO: 819 - DNA, 40 bp, artificial sequence
  primer Lum_R14
attaatcaacccatcataccaggacacatttttttgccag

SEQ ID NO: 820 - DNA, 40 bp, artificial sequence
  primer Lum_R15
attaatcaacccatgcaaccaggcatcatttttttgccag

SEQ ID NO: 821 - DNA, 40 bp, artificial sequence
  primer Lum_R16
attaatcaacccatcataccaggcatcatttttttgccag

SEQ ID NO: 822 - DNA, 23 bp, artificial sequence
  primer Dseq1
aacgcgtgaagcttttgaagatg

SEQ ID NO: 823 - DNA, 20 bp, artificial sequence
  primer Dseq2
tcagttcggaacaatcacgg

SEQ ID NO: 824 - DNA, 27 bp, artificial sequence
  primer Dseq3
tgctttccctttcatcaatgattgttg

SEQ ID NO: 825 - DNA, 23 bp, artificial sequence
  primer Dseq4
tccatgttagccatagcgataac

SEQ ID NO: 826 - DNA, 21 bp, artificial sequence
  primer Dseq5
ttgtgcttcaggagcgatatg

SEQ ID NO: 827 - DNA, 21 bp, artificial sequence
  primer N885
ctgctaatgtggaattgacac

SEQ ID NO: 828 - DNA, 12319 bp, artificial sequence; identical to SEQ ID NO: 699
  plasmid pBP3765

SEQ ID NO: 829 - DNA, 10934 bp, artificial sequence
  pRS423 TEF(M4) xpk1 ENO1-eutD
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcgcccgggccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 830 - DNA, 80 bp, Artificial Sequence
  primer N1341
gttgcaagaaatgcattatgcaattttttgattatgacaatctctcgaaaatagcttcaaaacgcttctacccccttttt

SEQ ID NO: 831 - DNA, 80 bp, Artificial Sequence
  primer N1338
catacattatacgaacggtactgaacattagaatacgtaatccgcaatgcccgcaaattaaagccttcgagcgtcccaaa

SEQ ID NO: 832 - DNA, 4242 bp, Artificial Sequence; identical to SEQ ID NO: 612
  pLA59

SEQ ID NO: 833 - DNA, 30 bp, Artificial Sequence
  primer N1033c
gcattgcggattacgtattctaatgttcag

SEQ ID NO: 834 - DNA, 81 bp, Artificial Sequence
  primer N1342
acatatgtgaaaaaaaatagttgatattttaaaccaaatcagaaatttatcaccttggctaactcgttgtatcatcactgg

SEQ ID NO: 835 - DNA, 30 bp, Artificial Sequence
  primer N1364
atgacaacagattactcatcaccagcatat

SEQ ID NO: 836 - DNA, 604 bp, Artificial Sequence
  FBA promoter variant L8
gcctacttggcttcacatacgttgcatacgacgatatagaaaataatgataatgacagcaggattatcgtataacgtaatagtcgaaaaatctcaaaaatctgtgggtcattacgtaaataatgataggaatgtgattcttctatttttcctttttccattctggcagccgtcgggaaaacgtggcttcctctctttcgggctctattggagtaacgctgccgtgagcttcctctctttccatatctaacaactgagcacgtaaccaatggtaaagcatgagcttagcgttgctccaaagaagtattggaaggttaataccatgtgtctgttctcttctgactttgactcctcaaataaaaaaaaattctacaatcaacagatcgcttcaattacgctctcacaaaaacttttttccttcttcttcgcccacgttaaattttaaccctcatgctgtctaacggatttctgcacttaatttattataaaacgacaaagacataatacttctctatcaatttcagttattgttcttcattgcattactcttctgttcttctttttcatttgtcatatacaaccataaccaaataatacatattcaa

SEQ ID NO: 837 - DNA, 80 bp, Artificial Sequence
  primer N1366
gttgcaagaaatgcattatgcaattttttgattatgacaatctctcgaaagcctacttggcttcacatacgttgcatacg

SEQ ID NO: 838 - DNA, 65 bp, Artificial Sequence
  primer N1368
atatgctggtgatgagtaatctgttgtcattttgaatatgtattatttggttatggttgtatatg

SEQ ID NO: 839 - DNA, 80 bp, Artificial Sequence
  primer N1371
aaaaactaatacgtaaacctgcattaaggtaagattatatcagaaaatgtgttgcaagaaatgcattatgcaattttttg

SEQ ID NO: 840 - DNA, 85 bp, Artificial Sequence
  primer N1372
tagaagctaatctttaacctggaagacaggacagaaaagtaattacaagaacatatgtgaaaaaaaatagttgatattttaaacc

SEQ ID NO: 841 - DNA, 25 bp, Artificial Sequence
  primer BK93
aaaaattgattctcatcgtaaatgc

SEQ ID NO: 842 - DNA, 30 bp, Artificial Sequence
  primer N1114
atatgctggtgatgagtaatctgttgtcat

SEQ ID NO: 843 - DNA, 6728 bp, Artificial Sequence
  pJT254
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 844 - DNA, 22 bp, Artificial Sequence
  primer N160SeqF5
cctgaagtctaggtccctattt

SEQ ID NO: 845 - DNA, 1650 bp, Saccharomyces cerevisiae; identical to SEQ ID NO: 722
  misc_feature (1)..(1650): AMN1

SEQ ID NO: 846 - protein, 549 aa, Saccharomyces cerevisiae
  misc_feature (1)..(1647): AMN1
MKLERVSSNGSFKRGRDIQSLESPCTRPLKKMSPSPSFTSLKMEKPFKDIVRKYGGHLHQSSYNPGSSKVELVRPDLSLKTDQSFLQSSVQTTPNKKSCNEYLSTPEATPLKNTATENAWATSRVVSASSLSIVTPTEIKNILVDEFSELKLGQPLTAQHQRSHAVFEIPEIVENIIKMIVSLESANIPKERPCLRRNPQSYEHSLLMYKDEERAKKAWSAAQQLRDPPLVGHKEKKQGALFSCMMVNRLWLNVTRPFLFKSLHFKSVHNFKEFLRTSQETTQVMRPSHFILHKLHQVTQPDIERLSRMECQNLKWLEFYVCPRITPPLSWFDNLHKLEKLIIPGNKNIDDNFLLRLSQSIPNLKHLVLRACDNVSDSGVVCIALNCPKLKTFNIGRHRRGNLITSVSLVALGKYTQVETVGFAGCDVDDAGIWEFARLNGKNVERLSLNSCRLLTDYSLPILFALNSFPNLAVLEIRNLDKITDVRHFVKYNLWKKSLDAPILIEACERITKLIDQEENRVKRINSLVALKDMTAWVNADDEIENNVD

SEQ ID NO: 847 - DNA, 6638 bp, Artificial Sequence
  pLA67 plasmid
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcattgcggattacgtattctaatgttcagtaccgttcgtataatgtatgctatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcgacttaggatgtctcatcaatcatcttattcctgctggtgttttttgtatcgccttgccttggagtgtttatgcttgtcctttgttcagtaaccattcttcaagtttgtttcaagtagtaggataccttcagatatacgaaagaaagggagtatagttgtggatatatatatatatagcaacccttctttataagggtcctatagactatactcttcacactttaaagtacggaattaaggcccaagggaactaacaaaaacgttcaaaaagttttaaaactatatgtgttaactgtacaaaaataacttatttatcatatcatttttttctctgtttatttcttctagaacttatacctgtcttttccttttattctttgaatttgktttaatatccctttttgktttaatatccatccattcctttcacttagaactaataattcccttcgtttgataatttatcattttccttttctgttagtaaagtacccattaaatgaagctggagcgcgtgagttctaacgggagctttaagcgtggccgtgacatccaaagtttggagagtccgtgtacccgcccattaaagaaaatgtcgccatcaccttcatttacgagcctgaagatggaaaaaccgtttaaggacattgttcgaaaatacgggggtcacctgcaccagtcctcgtataacccaggttcttcaaaagttgaactcgtgcgtccggacctgagcttgaaaacggaccaatcatttttgcagagcagcgtgcagacaaccccgaacaaaaagagttgtaacgagtatctgtccacacccgaagccactccccttaagaacacggccaccgagaatgcgtgggctacgtcaagggtggtgagcgcatcaagcctgtcaatcgtcacgccgaccgaaatcaaaaatatactggttgacgagtttagtgaactaaaacttggtcagcccttaacagcccagcaccaacggagccatgcagttttcgagatacctgagatcgtagagaacataatcaagatgatcgtttccctcgagagcgccaatattccgaaagaacgtccgtgcctgcgtcgcaacccgcagagttatgagcattcccttctgatgtataaagacgaggaacgcgcgaagaaagcatggtccgcggctcaacaactgcgcgatccgccgctggtgggtcataaggaaaaaaaacagggcgctctgtttagctgcatgatggtcaaccgcctgtggttgaatgtcacgcgtccgttcttatttaagtctctgcatttcaaatcagtgcacaacttcaaagaatttctgcgcacaagtcaggaaaccacgcaagtgatgaggccatcgcactttatcctgcataaattgcaccaggtaacgcagccggatattgagagactgtctagaatggaatgccagaacctcaagtggttggaattttatgtatgtccccgtattacacctccactgtcttggttcgacaatttgcataagttagaaaaattaatcatccccggaaacaagaatatcgacgataatttcctcttacggctgtctcagagtattcctaacctgaaacacctcgtgcttcgtgcttgcgacaatgtttccgatagtggtgtagtttgtatcgccctgaactgccctaagctgaagacgttcaacatcggacgtcatcgccgcggcaatctgattacatcagttagcttggttgccctgggtaagtatacgcaagttgagaccgttggttttgcaggctgcgatgtggacgacgcaggcatatgggagttcgcgcgtttaaacgggaaaaacgtcgagcgcctgtcactcaacagttgccggcttttaaccgactatagcttgccaatcctgtttgcccttaatagtttcccgaaccttgcggtgttggaaattcgaaacctcgataaaattacagatgtccgccattttgtgaaatataatctgtggaagaaatcactggatgctcctatcctgattgaggcgtgcgaacgcataacaaagctgattgatcaggaagagaaccgggtcaaacgcataaatagcctggtcgctttaaaggatatgaccgcgtgggtgaacgctgacgatgaaattgaaaacaacgtcgattgagacgatgaaattgaaaacaacgtcgattgaggtaccatggtttttgtgactttacctataaatagtacacaacagaccaccagtaattctacacacttcttaactgataatattattataattgtaactttttagcagcactaaatttaatgaatacatagatttttaactagcattttactattctgtactttttacttgaaattccagaagggccgaagaaaccagaattccttcacagaaaacgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 848 - DNA, 100 bp, Artificial Sequence
  primer LA712
cttaattgaaagaaagaatttccttcaacttcggtttcctggttccgctatttctcgcttgtttcttctagcattgcggattacgtattctaatgttcag

SEQ ID NO: 849 - DNA, 30 bp, Artificial Sequence
  primer LA746
gttttctgtgaaggaattctggtttcttcg

SEQ ID NO: 850 - DNA, 12298 bp, artificial sequence
  plasmid pBP3763
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttaattaatcattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaacaatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 851 - DNA, 12319 bp, artificial sequence
  plasmid pBP3767
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttaattaatcaaccacaagcaccaggagcacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaacaatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 852 - DNA, 12319 bp, artificial sequence
  plasmid pBP3769
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttaattaatcaaccacaagaaccaggagaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaacaatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 853 - DNA, 12319 bp, artificial sequence
  plasmid pBP3771
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttaattaatcaaccagaagcaccaggagcagattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaacaatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 854 - DNA, 1650 bp, Artificial sequence; identical to SEQ ID NO: 722
  Codon-optimized version of the AMN1 gene from CEN.PK2

SEQ ID NO: 855 - DNA, 7461 bp, artificial sequence
  plasmid pHR81
tgcagcgtcacatcggataataatgatggcagccattgtagaagtgccttttgcatttctagtctctttctcggtctagctagttttactacatcgcgaagatagaatcttagatcacactgcctttgctgagctggatcaatagagtaacaaaagagtggtaaggcctcgttaaaggacaaggacctgagcggaagtgtatcgtacagtagacggagtatactagagtcgacctgcaggcatgcaagcttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaaattgtaaacgttaatattttgttaaaattcgcgttaaatttttgttaaatcagctcattttttaaccaatagaccgaaatcggcaaaatcccttataaatcaaaagaatagcccgagatagagttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctaaggcgctggcaagtgtagcggtcacgctgcgcgtaaccaccacacccgccgcgcttaatgcgccgctacagggcgcgtactatggttgctttgacgtatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagtttctcggtactatgcatatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttaacaaagatatgctattgaagtgcaagatggaaacgcagaaaatgaaccggggatgcgacgtgcaagattacctatgcaatagatgcaatagtttctccaggaaccgaaatacatacattgtcttccgtaaagcgctagactatatattattatacaggttcaaatatactatctgtttcagggaaaactcccaggttcggatgttcaaaattcaatgatgggtaacaagtacgatcgtaaatctgtaaaacagtttgtcggatattaggctgtatctcctcaaagcgtattcgaatatcattgagaagctgcattttttttttttttttttttttttttttttatatatatttcaaggatataccattgtaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgttccacttccagatgaggcgctggaagcctccaagaaggctgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgttagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaagttcaacatcaattgattgattctgccgccatgatcctagttaagaacccaacccacctaaatggtattataatcaccagcaacatgtttggtgatatcatctccgatgaagcctccgttatcccaggctccttgggtttgttgccatctgcgtccttggcctctttgccagacaagaacaccgcatttggtttgtacgaaccatgccatggttccgctccagatttgccaaagaataaggtcaaccctatcgccactatcttgtctgctgcaatgatgttgaaattgtcattgaacttgcctgaagaaggtaaagccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacaaaaaaaaaaaaaaaaaaaaaaaaaaaaaaaaaaaaaaaaaaaaaaaaaaaa

SEQ ID NO: 856 - DNA, 11361 bp, artificial sequence
  plasmid pBP5062
ggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagc

SEQ ID NO: 857 - DNA, 11361 bp, artificial sequence
  plasmid pBP5063
ggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgataaagagaagctgaaaaatttaagaaatcgtagctctgtgtacgattcaatggtcaagtcacccaatcgtgctatgttgcgtgcaactggcatgactgacaaagatttcgaaacacctattgttggtgtgatttctacctgggctgaaaatacaccatgtaacatacatttacatgatttcggaaaactagcaaaagttggtattaaagatgcaggagcatggcccgtacaatttggtacaatcacagttgcagatggtattgctatgggaacccaaggcatgcgtttctccttaacttcacgcgatattatcgctgactcaattgaagcggctatgggaggacataacgctgatgcttttgttgctattggcggctgtgataaaaacatgcccggatctgtcattgctatggctaatatggatatcccagctatctttgcctatggcggtaccattgctcctggcagtttagatggtaaagatattgatttggtatctgtatttgaaggagtcggtcattggaatcatggagatatgactgaagaagaagttaaagctttagaatgcaatgcctgtcctggacctggtggctgtgggggaatgtatactgcaaatactatggcaacagctatcgaagtactaggactcagtcttccaggctcatcatctcatcctgctgaatcggcagataaaaaagctgacattgaagaagctggccgcgctgttgttaaaatgcttgagttaggaattaaaccatcagatattctaacgcgtgaagcttttgaagatgctatcactgtgactatggcattaggaggctccactaactcgacgcttcatcttttggctattgctcatgctgctaatgttgatctaactcttgatgattttaataccttccaagagaaagttcctcatttagctgatttaaaaccatcaggacaatatgttttccaagatctttatgaagctggcggtgttccagcagttatgaaataccttttagctaatggctttctccatggagatcgtataacttgcactggtaaaacagttgctgaaaatttggaaaacttctcagacttagctcccggccaaaaagttatcatgccacttgatcatcctaaacgagctgatggtccccttatcattttacacggcaacttagccccagatggtgctgttgctaaagtctctggtgttaaagttcgccgccatgtcggacctgctaaagtttttaattcagaagaagaagccattgaagccgtattgaatgatgatattgttgatggagatgtcgttgtcgttcggtttgtgggacctaaaggcggtcctggtatgccagaaatgctgtcactatcatctatgattgtcggtaaaggacaaggtgaaaaagtggctctgctcacagacggacggttttctggcggtacttatggattagttgtcggccatattgctcctgaagctcaagatggcggtcctattgcttacctacaaacaggtgatatcgtgacgattgatcaggatacaaaagaattacactttgatatcacagaagaagagttgaaacaccgtcaggaaacaacccagctaccaccgctttattcacgtggagtacttggtaaatacgctcatattgtatcatcagcatccaaaggagctgtaacagacttttggaaaccagaagagactggtaaaaaataagc

SEQ ID NO: 858 - DNA, 11361 bp, Artificial sequence; identical to SEQ ID NO: 788
  pHR81 FBA-IlvD(Sm)

SEQ ID NO: 859 - DNA, 11334 bp, Artificial sequence
  pHR81 FBA-IlvD(Sm)delta9
ggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttgagc

SEQ ID NO: 860 - DNA, 1737 bp, Artificial Sequence
  DNA sequence of 689-P2A1 Tagged S. mutans DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatgctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaa

SEQ ID NO: 861 - protein, 578 aa, Artificial Sequence
  amino acid sequence of 689-P2A1 Tagged S. mutans DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENAKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKKCCPGCCG

SEQ ID NO: 862 - DNA, 1737 bp, Artificial Sequence
  DNA sequence of 689-G2S2 Tagged S. mutans DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagattctccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaa

SEQ ID NO: 863 - protein, 578 aa, Artificial Sequence
  amino acid sequence of 689-G2S2 Tagged S. mutans DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDSPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKKCCPGCCG

SEQ ID NO: 864 - DNA, 1737 bp, Artificial Sequence
  DNA sequence of 689-L2F3 Tagged S. mutans DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgttcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaa

SEQ ID NO: 865 - protein, 578 aa, Artificial Sequence
  amino acid sequence of 689-L2F3 Tagged S. mutans DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPFIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKKCCPGCCG

SEQ ID NO: 866 - DNA, 1737 bp, Artificial Sequence; identical to SEQ ID NO: 706
  DNA sequence of 689-L2V4 Tagged S. mutans DHAD variant

SEQ ID NO: 867 - protein, 578 aa, Artificial Sequence; identical to SEQ ID NO: 707
  amino acid sequence of 689-L2V4 Tagged S. mutans DHAD variant

SEQ ID NO: 868 - DNA, 1737 bp, Artificial Sequence
  DNA sequence of 689-I2M6 Tagged S. mutans DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattatgctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaa

SEQ ID NO: 869 - protein, 578 aa, Artificial Sequence
  amino acid sequence of 689-I2M6 Tagged S. mutans DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIMLHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKKCCPGCCG

SEQ ID NO: 870 - DNA, 1737 bp, Artificial Sequence
  DNA sequence of 689-L2I7 Tagged S. mutans DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattatccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaa

SEQ ID NO: 871 - protein, 578 aa, Artificial Sequence
  amino acid sequence of 689-L2I7 Tagged S. mutans DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIIIHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKKCCPGCCG

SEQ ID NO: 872 - DNA, 1737 bp, Artificial Sequence
  DNA sequence of 689-L2M8 Tagged S. mutans DHAD variant
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattatgcatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaa

SEQ ID NO: 873 - protein, 578 aa, Artificial Sequence
  amino acid sequence of 689-L2M8 Tagged S. mutans DHAD variant
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIIMHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKKCCPGCCG

SEQ ID NO: 874 - DNA, 11013 bp, Artificial Sequence
  plasmid construct pRS413 BiADH kivD
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctgtacgcatgtaacattatactgaaaaccttgcttgagaaggttttgggacgctcgaaggctttaatttcctgcaggaattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaagtttaaacatgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaacctgcagggccgtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggataacgattctgaagttactcttagcgttcctatcggtacagccatcaaatcatgcctataaatcatgcctatatttgcgtgcagtcagtatcatctacatgaaaaaaactcccgcaatttcttatagaatacgttgaaaattaaatgtacgcgccaagataagataacatatatctagatgcagtaatatacacagattcccgcggacgtgggaaggaaaaaattagataacaaaatctgagtgatatggaaattccgctgtatagctcatatctttccctacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgaaagcattagtgtataggggcccaggccagaagttggtggaagagagacagaagccagagcttaaggaacctggtgacgctatagtgaaggtaacaaagactacaatttgcggaaccgatctacacattcttaaaggtgacgttgcgacttgtaaacccggtcgtgtattagggcatgaaggagtgggggttattgaatcagtcggatctggggttactgctttccaaccaggcgatagagttttgatatcatgtatatcgagttgcggaaagtgctcattttgtagaagaggaatgttcagtcactgtacgaccgggggttggattctgggcaacgaaattgatggtacccaagcagagtacgtaagagtaccacatgctgacacatccctttatcgtattccggcaggtgcggatgaagaggccttagtcatgttatcagatattctaccaacgggttttgagtgcggagtcctaaacggcaaagtcgcacctggttcttcggtggctatagtaggtgctggtcccgttggtttggccgccttactgacagcacaattctactccccagctgaaatcataatgatcgatcttgatgataacaggctgggattagccaaacaatttggtgccaccagaacagtaaactccacgggtggtaacgccgcagccgaagtgaaagctcttactgaaggcttaggtgttgatactgcgattgaagcagttgggatacctgctacatttgaattgtgtcagaatatcgtagctcccggtggaactatcgctaatgtcggcgttcacggtagcaaagttgatttgcatcttgaaagtttatggtcccataatgtcacgattactacaaggttggttgacacggctaccaccccgatgttactgaaaactgttcaaagtcacaagctagatccatctagattgataacacatagattcagcctggaccagatcttggacgcatatgaaacttttggccaagctgcgtctactcaagcactaaaagtcatcatttcgatggaggcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 875 - protein, 11 aa, Artificial Sequence
  conserved DHAD motif
  MISC_FEATURE (3)..(3): X may be any natural or non-natural amino acid
  MISC_FEATURE (4)..(4): X may be any natural or non-natural amino acid
  MISC_FEATURE (5)..(5): X may be any natural or non-natural amino acid
  MISC_FEATURE (7)..(7): X may be any natural or non-natural amino acid
  MISC_FEATURE (8)..(8): X may either be isoleucine or leucine
  MISC_FEATURE (9)..(9): X may be any natural or non-natural amino acid
PKXXXGXXXIL

What is claimed is:

1. An isolated polypeptide or fragment thereof having dihydroxy-acid dehydratase (DHAD) activity, wherein the polypeptide or fragment thereof comprises an amino acid sequence which is at least 95% identical to the amino acid sequence of SEQ ID NO: 565, and wherein the amino acid sequence comprises a deletion of about 5 to about 20 amino acids from the C-terminal end of the amino acid sequence.

2. The isolated polypeptide or fragment thereof of claim 1, wherein the amino acid sequence further comprises one or more amino acid substitutions selected from P378A, P378G, P378V, P378I, P378L, G383S, G383A, G383V, G383L, G383I, I387V, I387M, I387L, I387G, I387A, L388I, L388V, L388A, and L388M.

3. The isolated polypeptide or fragment thereof of claim 1, wherein the polypeptide or fragment thereof having DHAD activity catalyzes the conversion of 2,3-dihydroxyisovalerate to α-ketoisovalerate.

4. The isolated polypeptide or fragment thereof of claim 1, further comprising a polycysteine or polyhistidine tag.

5. The isolated polypeptide or fragment thereof of claim 4, further comprising the amino acid sequence of SEQ ID NO:589.

6. The isolated polypeptide or fragment thereof of claim 2, wherein the amino acid motif comprises the amino acid sequence of SEQ ID NO:573.

7. The isolated polypeptide or fragment thereof of claim 1, wherein the polypeptide or fragment thereof having DHAD activity is a [2Fe-2S]$^{2+}$DHAD.

8. The isolated polypeptide or fragment thereof of claim 1, wherein the polypeptide or fragment thereof having DHAD activity has an amino acid sequence that matches the Profile Hidden Markov Model (HMM) of Table 6 with an E value of <10$^5$.

9. The isolated polypeptide or fragment thereof of claim 1, wherein the polypeptide or fragment thereof having DHAD activity comprises three conserved cysteines corresponding to positions 56, 129, and 201 in the amino acid sequences of the *Streptococcus mutans* DHAD corresponding to SEQ ID NO:544.

10. The isolated polypeptide or fragment thereof of claim 1, wherein the polypeptide or fragment further comprises a polypeptide sequence selected from SEQ ID NO: 723, SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO:

739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, and SEQ ID NO: 748.

11. The isolated polypeptide or fragment thereof of claim 1, wherein the amino acid sequence comprises a deletion of about 5 to about 15 amino acids from the C-terminal end of the amino acid sequence.

12. The isolated polypeptide or fragment thereof of claim 1, wherein the amino acid sequence comprises a deletion of 9 C-terminal amino acids.

\* \* \* \* \*